United States Patent
Steichen et al.

(10) Patent No.: US 11,203,617 B2
(45) Date of Patent: Dec. 21, 2021

(54) IMMUNOGENIC TRIMERS

(71) Applicants: International AIDS Vaccine Initiative, New York, NY (US); The Scripps Research Institute, La Jolla, CA (US)

(72) Inventors: Jon Steichen, La Jolla, CA (US); Dan Kulp, New York, NY (US); Xiaozhen Hu, La Jolla, CA (US); Sergey Menis, New York, NY (US); William Schief, La Jolla, CA (US); Sebastian Raemisch, La Jolla, CA (US)

(73) Assignees: INTERNATIONAL AIDS VACCINE INITIATIVE, New York, NY (US); THE SCRIPPS RESEARCH INSTITUTE, La Jolla, CA (US)

( * ) Notice: Subject to any disclaimer, the term of this patent is extended or adjusted under 35 U.S.C. 154(b) by 0 days.

(21) Appl. No.: 16/139,173

(22) Filed: Sep. 24, 2018

(65) Prior Publication Data
US 2019/0085033 A1   Mar. 21, 2019

Related U.S. Application Data

(63) Continuation-in-part of application No. PCT/US2017/023854, filed on Mar. 23, 2017.

(60) Provisional application No. 62/384,762, filed on Sep. 8, 2016, provisional application No. 62/312,190, filed on Mar. 23, 2016.

(51) Int. Cl.
| | |
|---|---|
| *C07K 14/16* | (2006.01) |
| *A61K 39/21* | (2006.01) |
| *C07K 14/005* | (2006.01) |
| *A61K 39/00* | (2006.01) |

(52) U.S. Cl.
CPC ............ *C07K 14/162* (2013.01); *A61K 39/21* (2013.01); *C07K 14/005* (2013.01); *A61K 2039/575* (2013.01); *C07K 2319/20* (2013.01); *C07K 2319/21* (2013.01); *C07K 2319/70* (2013.01); *C12N 2740/16122* (2013.01); *C12N 2740/16134* (2013.01)

(58) Field of Classification Search
CPC .............................. C07K 14/162; A61K 39/21
See application file for complete search history.

(56) References Cited

U.S. PATENT DOCUMENTS

| | | |
|---|---|---|
| 2014/0212458 A1 | 7/2014 | Caulfield et al. |
| 2015/0238594 A1 | 8/2015 | Schief et al. |

FOREIGN PATENT DOCUMENTS

| | | |
|---|---|---|
| WO | 2015/134982 A1 | 9/2015 |
| WO | 2016/037154 A1 | 3/2016 |

OTHER PUBLICATIONS

Fitch, W. M., 2000, Homology: a personal view on some of the problems, TIG 16(5):227-231.*
TheiBen, G., 2002, Secret life of genes, Nature 415:741.*
Yang, X., et al., May 2000, Modifications That Stabilize Human Immunodeficiency Virus Envelope Glycoprotein Trimers in Solution, J. Virol. 74(10):4746-4754.*
Kalia, V., et al., Feb. 2005, Antibody Neutralization Escape Mediated by Point Mutations in the Intracytoplasmic Tail of Human Immunodeficiency Virus Type 1 gp41, J. Virol. 79(4):2097-2107.*
Watkins, B. A., et al., Dec. 1996, Resistance of Human Immunodeficiency Virus Type 1 to Neutralization by Natural Antisera Occurs through Single Amino Acid Substitutions That Cause Changes in Antibody Binding at Multiple Sites, J. Virol. 70(12):8431-8437.*
Sanders, et al, A Next-Generation Cleaved, Soluble HIV-1 Env Trimer, BG505 SOSIP.664 gp 140, Expresses Multiple Epitopes for Broadly Neutralizing Antibodies, PLOS Pathogens (Sep. 2013) vol. 9, Issue 9, e1003818, p. 1-20.

\* cited by examiner

*Primary Examiner* — Jeffrey S Parkin
(74) *Attorney, Agent, or Firm* — Duane Morris LLP; Thomas J. Kowalski; Deborah L. Lu

(57) ABSTRACT

The invention relates to PGT121-germline-targeting designs, trimer stabilization designs, combinations of those two, trimers designed with modified surfaces helpful for immunization regimens, other trimer modifications and on development of trimer nanoparticles and methods of making and using the same.

7 Claims, 42 Drawing Sheets

Figure 1:
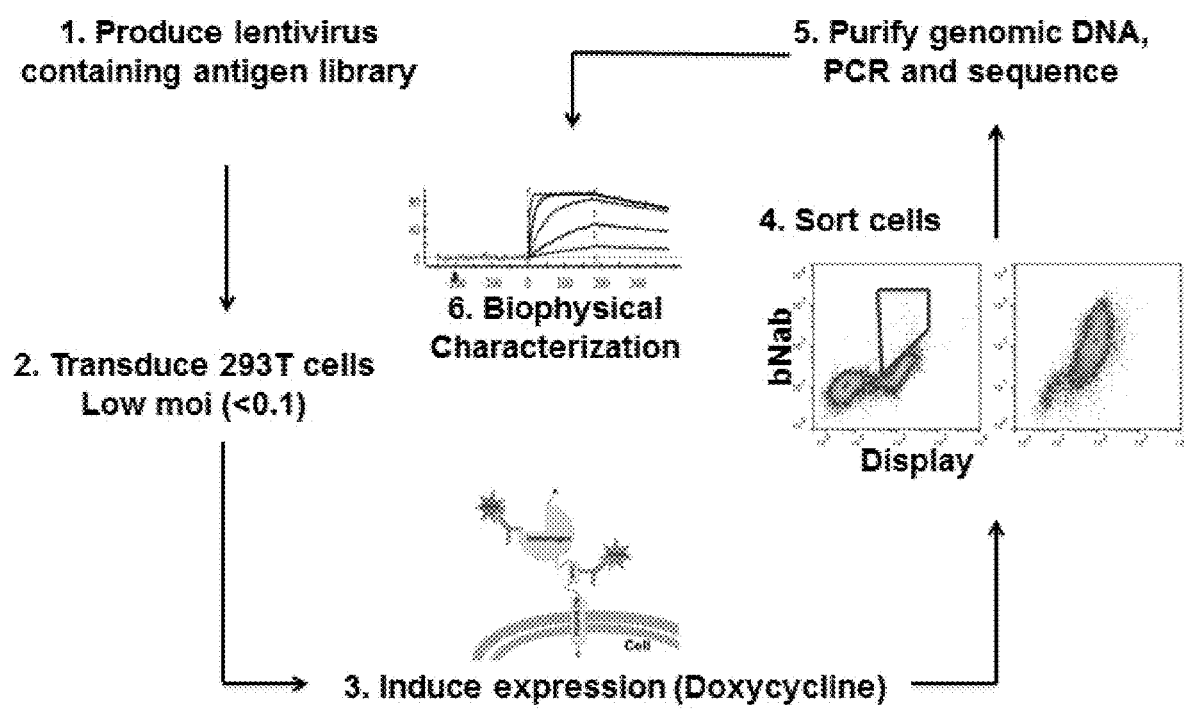
Figure 4:
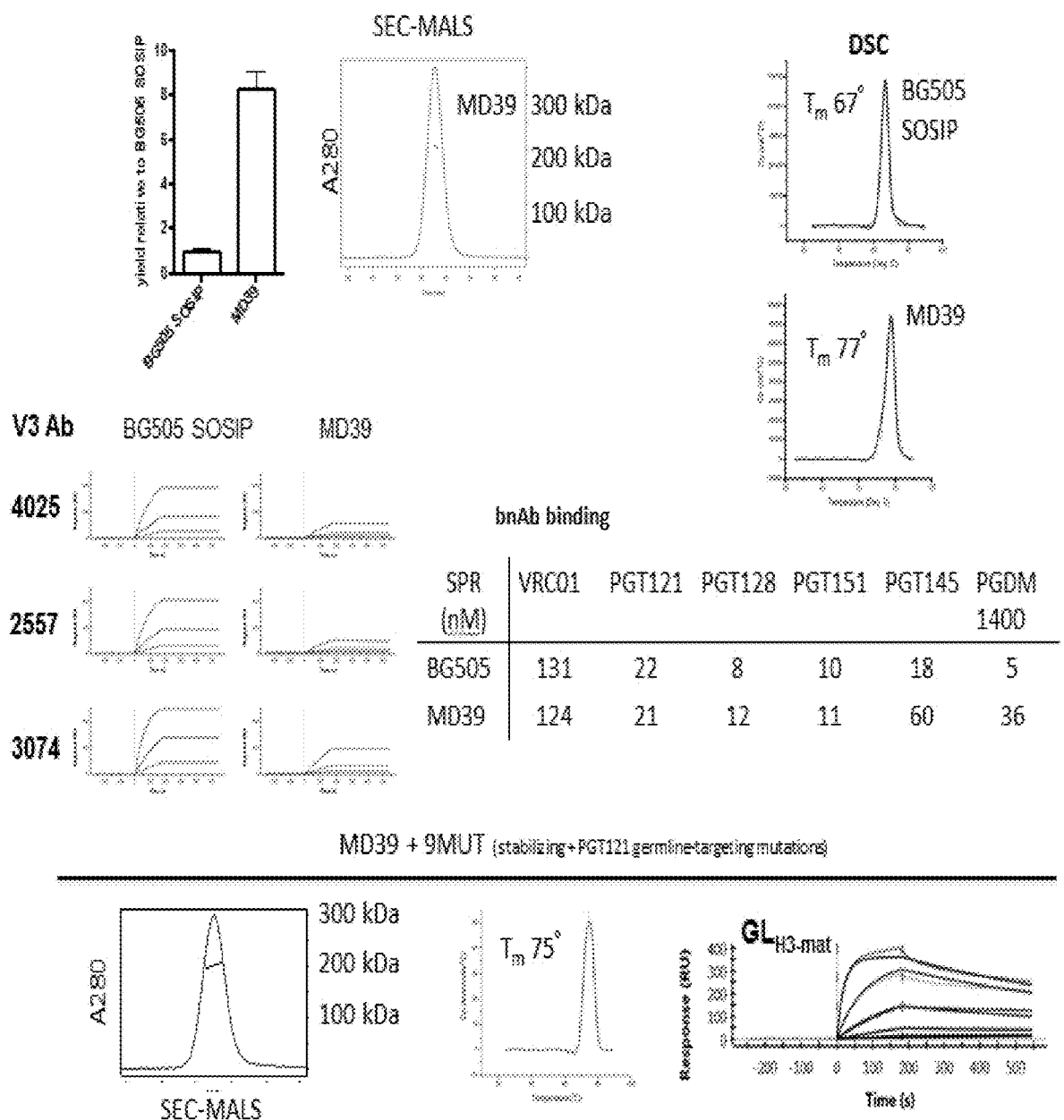

Specification includes a Sequence Listing.

FIG. 2

| BG505-gp120 | PGT121 | 3H3L | GL+12+ins | GL+12 | GL+6 | GL$_{H3\text{-}mat}$ | GL$_{H3\text{-}rev}$ | gH$_{H3\text{-}rev}$ matL | matH gL$_{L3\text{-}rev}$ |
|---|---|---|---|---|---|---|---|---|---|
| WT | 7 | 271 | 1500 | ~23000 | NB | NB | NB | 595 | NB |
| 3mut | 4 | 9 | 229 | 2100 | NB | NB | NB | 22 | NB |
| 5mut | 6 | 7 | 2 | 19 | ~208000 | | NB | 6 | ~12000 |
| 7mut | 0.2 | <0.1 | <0.1 | 3 | 6430 | ~62000 | NB | 1 | NB |
| 10mut | 0.06 | <0.1 | | | 1230 | 1070 | NB** | <0.1 | ~47000 |

FIG. 3

FIGS. 6A-6B

B6505-SOSIP.664_PDGFR_TM
MDAMHGLCCVLLLCGAVFVSPSQEIHARFRRGARAENLWVTVYYGVPVWKDAETTLFCASDAKAYETEKHNVWATHACVPTDPNPQEIHLENVTEEFN
MWKNNMVEQMHTDIISLWDQSLKPCVKLTPLCVTLQCTNVTNNITDDMRGELKNCSFNMTTELRDKKQKVYSLFYRLDVVQINENQGNRSNNSNKETRL
INCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPV
QINCTRPNNTRKSIRIGPGQAFYATGDIIGDIRQAHCNVSKATWNETLGKVVKQLRKHFGNNTIIRFANSSGGDLEVTTHSFNCGGEFFYCNTSGLFN
STWISNTSVQGSNSTGSNDSITLPCRIKQIINMWQRIGQAMYAPPIQGVIRCVSNITGLILTRDGGSTNSTTETFRPGGGDMRDNWRSELYKYKVVKIE
PLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLKD
QQLLGIWGCSGKLICTTNVPWNSSWSNRNLSEIWDNMTWLQWDKEISNYTQIIYGLLEESQNQQEKNEQDLLALDKWASLWNWFNITNWLWYIKLFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

GSGGSNAVQQTRVIVVPRGLFPKVVISAILALVVLTIISLIILIMLWQKKPR

B6505-gp120_PDGFR_TM
METTRTLLLWVLLLSVLPGSTSAENLWVTVYYGVPVWKDAETTLFCASDAKAYETEKHNVWATHACVPTDPNPQEIHLENVTEEFNMWKNNMVEQMHTD
IISLWDQSLKPCVKLTPLCVTLNCTNVTNNITDDMRGELKNCSFNMTTELRDKKQKVYSLFYRLDVVQINENQGNRSNNSNKETRLINCNTSAITQAC
PKVSFEPIPIHYCAPAGFAILKCKDKKFNGTGFCPSVSTVQCTHGIKPVVSTQLLLNGSLAEEEVMIRSENITNNAKNILVQFNTPVQINCTRPNNKT
RKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQ
GSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRA
KRRVVGGSGSGSGSSGGSNAVQQTRVIVVPRGLFPKVVISAILALVVLTIISLIILIMLWQKKPR

FIG. 9C

Heavy Chain

```
                            V
V4-59/D3-3/J6  QVQLQESGPGLVKPSETLSLTCTVSGGSISSYYWSWIRQPPGKGLEWIGYIYYSGSTNYNPSLKSRVTIS
GL-CDR3rev1    QVQLQESGPGLVKPSETLSLTCTVSGGSISSYYWSWIRQPPGKGLEWIGYIYYSGSTNYNPSLKSRVTIS
GL-CDR3rev2    QVQLQESGPGLVKPSETLSLTCTVSGGSISSYYWSWIRQPPGKGLEWIGYIYYSGSTNYNPSLKSRVTIS
GL-CDR3rev3    QVQLQESGPGLVKPSETLSLTCTVSGGSISSYYWSWIRQPPGKGLEWIGYIYYSGSTNYNPSLKSRVTIS
GL-CDR3rev4    QVQLQESGPGLVKPSETLSLTCTVSGGSISSYYWSWIRQPPGKGLEWIGYIYYSGSTNYNPSLKSRVTIS
GL-CDR3rev5    QVQLQESGPGLVKPSETLSLTCTVSGGSISSYYWSWIRQPPGKGLEWIGYIYYSGSTNYNPSLKSRVTIS
GL+3           QVQLQESGPGLVKPSETLSLTCTVSGGSISSYYWSWIRQPPGKGLEWIGYIYYSGSTNYNPSLKSRVTIS
GL-CDR3mat     QVQLQESGPGLVKPSETLSLTCTVSGGSISSYYWSWIRQPPGKGLEWIGYIYYSGSTNYNPSLKSRVTIS
GL+9           QVQLQESGPGLVKPSETLSLTCTVSGGSISSYYWSWIRQPPGKGLEWIGYIYYSGSTNYNPSLKSRVTIS
PGT121         QQLQESGPGLVKPSETLSLTC VSG SIS YWSWIR PGKGLEWIGY   G TNY PSLKSRV D              J
V4-59/D3-3/J6  VDTSKNQFSLKLSSVTAADTAVYYCAR----ITIFGVVII--YYYYYYMDVWGKGTTVTVSS
GL-CDR3rev1    VDTSKNQFSLKLSSVTAADTAVYYCAR    ITIFGVV    YYYYYYMDVWGKGTTVTVSS
GL-CDR3rev2    VDTSKNQFSLKLSSVTAADTAVYYCAR    ITIFGVVII   YYYYYYMDVWGKGTTVTVSS
GL-CDR3rev3    VDTSKNQFSLKLSSVTAADTAVYYCAR    I GVV      YYYYYYMDVWGKGTTVTVSS
GL-CDR3rev4    VDTSKNQFSLKLSSVTAADTAVYYCAR    I GVV      YYYYYYMDVWGKGTTVTVSS
GL-CDR3rev5    VDTSKNQFSLKLSSVTAADTAVYYCAR    ITIFGVV    YYYYYYMDVWGKGTTVTVSS
GL+3           VDTSKNQFSLKLSSVTAADTAVYYCAR    I GV       YYYMDVWGKGTTVTVSS
GL-CDR3mat     VDTSKNQFSLKLSSVTAADTAVYYCAR    I GV       YYYMDVWGKGTTVTVSS
GL+9           VDTSKNQFSLKLSSVTAADTAVYYCAR    I GV       YYYMDVWGKGTTVTVSS
PGT121         DTSKNQ SL L  TAAD  YYCAR       I GV        YMDVWG GT VTVSS
```

Light Chain

```
                            V
V3-21/J3       SYVLTQPPSVSVAPGQTARITCGGNNIGSKSVHWYQQKPGQAPVLVVYDDSDRPSGIPERFSGSNS---G
GL-CDR3rev1    SYVLTQPPSVSVAPGQTARITCGGNNIGSKSVHWYQQKPGQAPVLVVYDDSDRPSGIPERFSGSNS---G
GL-CDR3rev2    SYVLTQPPSVSVAPGQTARITCGGNNIGSKSVHWYQQKPGQAPVLVVYDDSDRPSGIPERFSGSNS---G
GL-CDR3rev3    SYVLTQPPSVSVAPGQTARITCGGNNIGSKSVHWYQQKPGQAPVLVVYDDSDRPSGIPERFSGSNS---G
GL-CDR3rev4    SYVLTQPPSVSVAPGQTARITCGGNNIGSKSVHWYQQKPGQAPVLVVYDDSDRPSGIPERFSGSNS---G
GL-CDR3rev5    SYVLTQPPSVSVAPGQTARITCGGNNIGSKSVHWYQQKPGQAPVLVVYDDSDRPSGIPERFSGSNS---G
GL+3           SYVLTQPPSVSVAPG TARITCGGNNIGSKSVHWYQQKPGQAPVLV YDDSDRPSGIPERFSGSNS---G
GL-CDR3mat     SYVLTQPPSVSVAPGQTARITCGGNNIGSKSVHWYQQKPGQAPVLVVYDDSDRPSGIPERFSGSNS---G
GL+9           SYVLTQPPSVSVAPG TARI CGGNNIGSKSV WYQQKPGQAPVLVVT  DRPSGIPERFSGS  ---G
PGT121         -------  SVAPG TARI CG  GS V WYC   GQAP L V  DRPSGIPERFSGS     G J
V3-21/J3       NTATLTISRVEAGDEADYYCQVWDSSSDHPWVFGGGTKLTVL
GL-CDR3rev1    NTATLTISRVEAGDEADYYCQVWDSSSDHPWVFGGGTKLTVL
GL-CDR3rev2    NTATLTISRVEAGDEADYYCQVWDS    WVFGGGTKLTVL
GL-CDR3rev3    NTATLTISRVEAGDEADYYCQVWDSSSDHPWVFGGGTKLTVL
GL-CDR3rev4    NTATLTISRVEAGDEADYYCQVWDSSSDHPWVFGGGTKLTVL
GL-CDR3rev5    NTATLTISRVEAGDEADYYCQVWDS    WVFGGGTKLTVL
GL+3           NTATLTISRVEAGDEADYYCQVWDS SDHPWVFGGGTKLTVL
GL-CDR3mat     NTATLTISRVEAGDEADYYCQVWDS    WVFGGGTKLTVL
GL+9           NTATLTISRVEAGDEADYYCQVWDS SDHPWVFGGGTKLTVL
PGT121         TATLTI VEAGDEADYYC WDS    WVFGGGT LTVL
```

FIG. 10

FIG. 11

```
BG505_SOSIP.664    AENLWVTVYYGVPVWKDAETTLFCASDAKAYETEKHNVWATHACVPTDPNPQEIHLENVTEEFNMWKNNMVEQMHTDIIS
BG505_SOSIP_rare3  AENLWVTVYYGVPVWKDAETTLFCASDAKAYETEKHNVWATHACVPTDPNPQEIHLENVTEEFNMWKNNMVEQMHTDIIS
BG505_SOSIP_MD16   AENLWVTVYYGVPVWKDAETTLFCASDAKAYETEKHNVWATHACVPTDPNPQEIHLENVTEEFNMWKNNMVEQMHTDIIS
BG505_SOSIP_MD2    AENLWVTVYYGVPVWKDAETTLFCASDAKAYETEKHNVWATHACVPTDPNPQEIHLENVTEEFNMWKNNMVEQMHTDIIS
BG505_SOSIP_MD33   AENLWVTVYYGVPVWKDAETTLFCASDAKAYETEKHNVWATHACVPTDPNPQEIHLENVTEEFNMWKNNMVEQMHTDIIS
BG505_SOSIP_MD39   AENLWVTVYYGVPVWKDAETTLFCASDAKAYETEKHNVWATHACVPTDPNPQEIHLENVTEEFNMWKNNMVEQMHTDIIS BG505_SOSIP.664    LWDQSLKPCVKLTPLCVTLQCTNVTNNITDDMRGELKNCSFNMTTELRDKKQKVYSLFYRLDVVQINENQGNRSNNSNKE
BG505_SOSIP_rare3  LWDQSLKPCVKLTPLCVTLQCTNVTNNITDDMRGELKNCSFNMTTELRDKKQKVYSLFYRLDVVQINENQGNRSNNSNKE
BG505_SOSIP_MD16   LWDQSLKPCVKLTPLCVTLQCTNVTNNITDDMRGELKNCSFNMTTELRDKKQKVYSLFYRLDVVQINENQGNRSNNSNKE
BG505_SOSIP_MD2    LWDQSLKPCVKLTPLCVTLQCTNVTNNITDDMRGELKNCSFNMTTELRDKKQKVYSLFYRLDVVQINENQGNRSNNSNKE
BG505_SOSIP_MD33   LWDQSLKPCVKLTPLCVTLQCTNVTNNITDDMRGELKNCSFNMTTELRDKKQKVYSLFYRLDVVQINENQGNRSNNSNKE
BG505_SOSIP_MD39   LWDQSLKPCVKLTPLCVTLQCTNVTNNITDDMRGELKNCSFNMTTELRDKKQKVYSLFYRLDVVQINENQGNRSNNSNKE BG505_SOSIP.664    YRLINCNTSAITQACPKVSFEPIPIHYCAPAGFAILKCKDKKFNGTGPCPSVSTVQCTHGIKPVVSTQLLLNGSLAEEEV
BG505_SOSIP_rare3  YRLINCNTSAITQACPKVSFEPIPIHYCAPAGFAILKCKDKKFNGTGPCPSVSTVQCTHGIKPVVSTQLLLNGSLAEEEV
BG505_SOSIP_MD16   YRLINCNTSAITQACPKVSFEPIPIHYCAPAGFAILKCKDKKFNGTGPCPSVSTVQCTHGIKPVVSTQLLLNGSLAEEEV
BG505_SOSIP_MD2    YRLINCNTSAITQACPKVSFEPIPIHYCAPAGFAILKCKDKKFNGTGPCPSVSTVQCTHGIKPVVSTQLLLNGSLAEEEV
BG505_SOSIP_MD33   YRLINCNTSAITQACPKVSFEPIPIHYCAPAGFAILKCKDKKFNGTGPCPSVSTVQCTHGIKPVVSTQLLLNGSLAEEEV
BG505_SOSIP_MD39   YRLINCNTSAITQACPKVSFEPIPIHYCAPAGFAILKCKDKKFNGTGPCPSVSTVQCTHGIKPVVSTQLLLNGSLAEEEV BG505_SOSIP.664    MIRSENITNNAKNILVQFNTPVQINCTRPNNNTRKSIRIGPGQAFYATGDIIGDIRQAHCNVSKATWNETLGKVVKQLRK
BG505_SOSIP_rare3  MIRSENITNNAKNILVQFNTPVQINCTRPNNNTRKSIRIGPGQAFYATGDIIGDIRQAHCNVSKATWNETLGKVVKQLRK
BG505_SOSIP_MD16   MIRSENITNNAKNILVQFNTPVQINCTRPNNNTRKSIRIGPGQAFYATGDIIGDIRQAHCNVSKATWNETLGKVVKQLRK
BG505_SOSIP_MD2    MIRSENITNNAKNILVQFNTPVQINCTRPNNNTRKSIRIGPGQAFYATGDIIGDIRQAHCNVSKATWNETLGKVVKQLRK
BG505_SOSIP_MD33   MIRSENITNNAKNILVQFNTPVQINCTRPNNNTRKSIRIGPGQAFYATGDIIGDIRQAHCNVSKATWNETLGKVVKQLRK
BG505_SOSIP_MD39   MIRSENITNNAKNILVQFNTPVQINCTRPNNNTRKSIRIGPGQAFYATGDIIGDIRQAHCNVSKATWNETLGKVVKQLRK BG505_SOSIP.664    HFGNNTIIRFANSSGGDLEVTTHSFNCGGEFFYCNTSGLFNSTWISNTSVQGSNSTGSNDSITLPCRIKQIINMWQRIGQ
BG505_SOSIP_rare3  HFGNNTIIRFANSSGGDLEVTTHSFNCGGEFFYCNTSGLFNSTWISNTSVQGSNSTGSNDSITLPCRIKQIINMWQRIGQ
BG505_SOSIP_MD16   HFGNNTIIRFANSSGGDLEVTTHSFNCGGEFFYCNTSGLFNSTWISNTSVQGSNSTGSNDSITLPCRIKQIINMWQRIGQ
BG505_SOSIP_MD2    HFGNNTIIRFANSSGGDLEVTTHSFNCGGEFFYCNTSGLFNSTWISNTSVQGSNSTGSNDSITLPCRIKQIINMWQRIGQ
BG505_SOSIP_MD33   HFGNNTIIRFANSSGGDLEVTTHSFNCGGEFFYCNTSGLFNSTWISNTSVQGSNSTGSNDSITLPCRIKQIINMWQRIGQ
BG505_SOSIP_MD39   HFGNNTIIRFANSSGGDLEVTTHSFNCGGEFFYCNTSGLFNSTWISNTSVQGSNSTGSNDSITLPCRIKQIINMWQRIGQ BG505_SOSIP.664    AMYAPPIQGVIRCVSNITGLILTRDGGSTNSTTETFRPGGGDMRDNWRSELYKYKVVKIEPLGVAPTRCKRRVVGRRRRR
BG505_SOSIP_rare3  AMYAPPIQGVIRCVSNITGLILTRDGGSTNSTTETFRPGGGDMRDNWRSELYKYKVVKIEPLGVAPTRCKRRVVGRRRRR
BG505_SOSIP_MD16   AMYAPPIQGVIRCVSNITGLILTRDGGSTNSTTETFRPGGGDMRDNWRSELYKYKVVKIEPLGVAPTRCKRRVVGRRRRR
BG505_SOSIP_MD2    AMYAPPIQGVIRCVSNITGLILTRDGGSTNSTTETFRPGGGDMRDNWRSELYKYKVVKIEPLGVAPTRCKRRVVGRRRRR
BG505_SOSIP_MD33   AMYAPPIQGVIRCVSNITGLILTRDGGSTNSTTETFRPGGGDMRDNWRSELYKYKVVKIEPLGVAPTRCKRRVVGRRRRR
BG505_SOSIP_MD39   AMYAPPIQGVIRCVSNITGLILTRDGGSTNSTTETFRPGGGDMRDNWRSELYKYKVVKIEPLGVAPTRCKRRVVGRRRRR BG505_SOSIP.664    RAVGIGAVFLGFLGAAGSTMGAASMTLTVQARNLLSGIVQQQSNLLRAPEAQQHLLKLTVWGIKQLQARVLAVERYLRDQ
BG505_SOSIP_rare3  RAVGIGAVFLGFLGAAGSTMGAASMTLTVQARNLLSGIVQQQSNLLRAPEAQQHLLKLTVWGIKQLQARVLAVERYLRDQ
BG505_SOSIP_MD16   RAVGIGAVFLGFLGAAGSTMGAASMTLTVQARNLLSGIVQQQSNLLRAPEAQQHLLKLTVWGIKQLQARVLAVERYLRDQ
BG505_SOSIP_MD2    RAVGIGAVFLGFLGAAGSTMGAASMTLTVQARNLLSGIVQQQSNLLRAPEAQQHLLKLTVWGIKQLQARVLAVERYLRDQ
BG505_SOSIP_MD33   RAVGIGAVFLGFLGAAGSTMGAASMTLTVQARNLLSGIVQQQSNLLRAPEAQQHLLKLTVWGIKQLQARVLAVERYLRDQ
BG505_SOSIP_MD39   RAVGIGAVFLGFLGAAGSTMGAASMTLTVQARNLLSGIVQQQSNLLRAPEAQQHLLKLTVWGIKQLQARVLAVERYLRDQ BG505_SOSIP.664    QLLGIWGCSGKLICCTNVPWNSSWSNRNLSEIWDNMTWLQWDKEISNYTQIIYGLLEESQNQQEKNEQDLLALD
BG505_SOSIP_rare3  QLLGIWGCSGKLICCTNVPWNSSWSNRNLSEIWDNMTWLQWDKEISNYTQIIYGLLEESQNQQEKNEQDLLALD
BG505_SOSIP_MD16   QLLGIWGCSGKLICCTNVPWNSSWSNRNLSEIWDNMTWLQWDKEISNYTQIIYGLLEESQNQQEKNEQDLLALD
BG505_SOSIP_MD2    QLLGIWGCSGKLICCTNVPWNSSWSNRNLSEIWDNMTWLQWDKEISNYTQIIYGLLEESQNQQEKNEQDLLALD
BG505_SOSIP_MD33   QLLGIWGCSGKLICCTNVPWNSSWSNRNLSEIWDNMTWLQWDKEISNYTQIIYGLLEESQNQQEKNEQDLLALD
BG505_SOSIP_MD39   QLLGIWGCSGKLICCTNVPWNSSWSNRNLSEIWDNMTWLQWDKEISNYTQIIYGLLEESQNQQEKNEQDLLALD
```

FIG. 13A

B.

| Trimer | Tm (°C) |
|---|---|
| BG505 SOSIP | 66.65 |
| rare3 | 68.08 |
| MD16 | 66.5 |
| MD2 | 66.99 |
| MD33 | 70.65 |
| MD39 | 77.17 |

| | Dissociation constant $K_d$ (nM) | | | | | | Tm (°C) | Yield PEI |
|---|---|---|---|---|---|---|---|---|
| | VRC01 | 121 | 128 | 151 | 145 | 1400 | | |
| BG505 | 131 | 22 | 8 | 10 | 6 | 2 | 66 | 1 |
| MD39-VLC1 | 416 | 42 | 5 | 10 | 31 | - | 73 | 13.7 |
| MD39-VLC2 | 124 | 21 | 12 | 11 | 20 | 12 | 77 | 6.2 |
| MD39-VLC3 | 449 | 15 | 7 | 11 | 33 | - | 77 | 7.0 |
| MD39-VLC4 | 167 | 13 | 2 | 11 | 27 | - | 76 | 6.3 |
| MD39-VLC5 | 121 | 50 | 7 | 10 | 11 | - | 74 | 10.5 |

FIG. 14A

```
BG505_SOSIP_D664_MD39      AENLWVTVYYGVPVWKDAETTLFCASDAKAYETEKHNVWATHACVPTDPNPQEIHLENVTEEFNMWKNNMVE
BG505_SOSIP_MD39_VLC1-03   AENLWVTVYYGVPVWKDAETTLFCASDAKAYETEKHNVWATHACVPTDPNPQEIHLENVTEEFNMWKNNMVE
BG505_SOSIP_MD39_VLC2-04   AENLWVTVYYGVPVWKDAETTLFCASDAKAYETEKHNVWATHACVPTDPNPQEIHLENVTEEFNMWKNNMVE
BG505_SOSIP_MD39_VLC2-08   AENLWVTVYYGVPVWKDAETTLFCASDAKAYETEKHNVWATHACVPTDPNPQEIHLENVTEEFNMWKNNMVE
BG505_SOSIP_MD39_VLC3-13   AENLWVTVYYGVPVWKDAETTLFCASDAKAYETEKHNVWATHACVPTDPNPQEIHLENVTEEFNMWKNNMVE

BG505_SOSIP_D664_MD39      QMHEDIISLWDQSLKPCVKLTPLCVTLQC------TNVTNNITDD----MRGELKNCSFNMTTELRDKKQKV
BG505_SOSIP_MD39_VLC1-03   QMHEDIISLWDQSLKPCVKLTPLCVTLQC------T       ----MGEL KNCSFNMTTELRDKKQKV
BG505_SOSIP_MD39_VLC2-04   QMHEDIISLWDQSLKPCVKLTPLCVTLQC              ----EKGE KNCSFNMTTELRDKKQKV
BG505_SOSIP_MD39_VLC2-08   QMHEDIISLWDQSLKPCVKLTPLCVTLQ               ----    KNCSFNMTTELRDKKQKV
BG505_SOSIP_MD39_VLC3-13   QMHEDIISLWDQSLKPCVKLTPLCVTLQC      -TNVT      ----    NCSFNMTTELRDKKQKV

BG505_SOSIP_D664_MD39      YSLFYRLDVVQINEN-----------OGNRSNNSNPEYRLINCNTSAITQACPKVSFEPIPIHYCAPAGFAI
BG505_SOSIP_MD39_VLC1-03   YSLFY LD     I -----------         YRLINCNTSAITQACPKVSFEPIPIHYCAPAGFAI
BG505_SOSIP_MD39_VLC2-04   YSLFY LD     I       -----         YRLINCNTSAITQACPKVSFEPIPIHYCAPAGFAI
BG505_SOSIP_MD39_VLC2-08   YSLFYRLD   I      -----           YRLINCNTSAITQACPKVSFEPIPIHYCAPAGFAI
BG505_SOSIP_MD39_VLC3-13   YSLFY LD  VQIN  -----------         YRLINCNTSAITQACPKVSFEPIPIHYCAPAGFAI

BG505_SOSIP_D664_MD39      LKCKDKKFNGTGPCPSVSTVQCTHGIKPVVSTQLLLNGSLAEEEVIIRSENITNNAKNILVQLNTPVQINCT
BG505_SOSIP_MD39_VLC1-03   LKCKDKKFNGTGPCPSVSTVQCTHGIKPVVSTQLLLNGSLAEEEVIIRSENITNNAKNILVQLNTPVQINCT
BG505_SOSIP_MD39_VLC2-04   LKCKDKKFNGTGPCPSVSTVQCTHGIKPVVSTQLLLNGSLAEEEVIIRSENITNNAKNILVQLNTPVQINCT
BG505_SOSIP_MD39_VLC2-08   LKCKDKKFNGTGPCPSVSTVQCTHGIKPVVSTQLLLNGSLAEEEVIIRSENITNNAKNILVQLNTPVQINCT
BG505_SOSIP_MD39_VLC3-13   LKCKDKKFNGTGPCPSVSTVQCTHGIKPVVSTQLLLNGSLAEEEVIIRSENITNNAKNILVQLNTPVQINCT

BG505_SOSIP_D664_MD39      RPNNNTVKSIRIGPGQAFYYTGDIIGDIRQAHCNVSKATWNETLGKVVKQLRKHFGNNTIIRFAQSSGGDLE
BG505_SOSIP_MD39_VLC1-03   RPNNNTVKSIRIGPGQAFYYTGDIIGDIRQAHCNVS              HFGNNTIIRFAQSSGGDLE
BG505_SOSIP_MD39_VLC2-04   RPNNNTVKSIRIGPGQAFYYTGDIIGDIRQAHCNVS              HFGNNTIIRFAQSSGGDLE
BG505_SOSIP_MD39_VLC2-08   RPNNNTVKSIRIGPGQAFYYTGDIIGDIRQAHCNVSK             HFGNNTIIRFAQSSGGDLE
BG505_SOSIP_MD39_VLC3-13   RPNNNTVKSIRIGPGQAFYYTGDIIGDIRQAHCNVSG    NETL      RKHFGNNTIIRFAQSSGGDLE

BG505_SOSIP_D664_MD39      VTTHSFNCGGEFFYCNTSGLFNSTWISNT------SVQGSNSTGSNDSITLPCRIKQIIMWQRIGQAMYAPP
BG505_SOSIP_MD39_VLC1-03   VTTHSFNCGGEFFYCNTSGLFNG        ------        G ITLPCRIKQIIMWQRIGQAMYAPP
BG505_SOSIP_MD39_VLC2-04   VTTHSFNCGGEFFYCNTSGLFNSTV            ND ITLPCRIKQIIMWQRIGQAMYAPP
BG505_SOSIP_MD39_VLC2-08   VTTHSFNCGGEFFYCNTSGLFNSTWI          SNST    ITLPCRIKQIIMWQRIGQAMYAPP
BG505_SOSIP_MD39_VLC3-13   VTTHSFNCGGEFFYCNTSGLFNST    ------  GS------   ITLPCRIKQIIMWQRIGQAMYAPP

BG505_SOSIP_D664_MD39      IQGVIRCVSNITGLILTRDGGSTN-STTETFRPGGGDMRDNWRSELYKYKVVKIEPLGVAPTRCKRRVVGRR
BG505_SOSIP_MD39_VLC1-03   IQGVIRCVSNITGLILTRDGG    -    ETFRPGGGDMRDNWRSELYKYKVVKIEPLGVAPTRCKRRVVGRR
BG505_SOSIP_MD39_VLC2-04   IQGVIRCVSNITGLILTRDGG    -    TETFRPGGGDMRDNWRSELYKYKVVKIEPLGVAPTRCKRRVVGRR
BG505_SOSIP_MD39_VLC2-08   IQGVIRCVSNITGLILTRDGG         TETFRPGGGDMRDNWRSELYKYKVVKIEPLGVAPTRCKRRVVGRR
BG505_SOSIP_MD39_VLC3-13   IQGVIRCVSNITGLILTRDGG    -    TETFRPGGGDMRDNWRSELYKYKVVKIEPLGVAPTRCKRRVVGRR

BG505_SOSIP_D664_MD39      RRRRAVGIGAVSLGFLGAAGSTMGAASMTLTVQARNLLSGIVQQQSNLLRAPEPQQHLLKDTHWGIKQLQAR
BG505_SOSIP_MD39_VLC1-03   RRRRAVGIGAVSLGFLGAAGSTMGAASMTLTVQARNLLSGIVQQQSNLLRAPEPQQHLLKDTHWGIKQLQAR
BG505_SOSIP_MD39_VLC2-04   RRRRAVGIGAVSLGFLGAAGSTMGAASMTLTVQARNLLSGIVQQQSNLLRAPEPQQHLLKDTHWGIKQLQAR
BG505_SOSIP_MD39_VLC2-08   RRRRAVGIGAVSLGFLGAAGSTMGAASMTLTVQARNLLSGIVQQQSNLLRAPEPQQHLLKDTHWGIKQLQAR
BG505_SOSIP_MD39_VLC3-13   RRRRAVGIGAVSLGFLGAAGSTMGAASMTLTVQARNLLSGIVQQQSNLLRAPEPQQHLLKDTHWGIKQLQAR

BG505_SOSIP_D664_MD39      VLAVEHYLRDQQLLGIWGCSGKLICCTNVPWNSSWSNRNLSEIWDNMTWLQWDKEISNYTQIIYGLLEESQN
BG505_SOSIP_MD39_VLC1-03   VLAVEHYLRDQQLLGIWGCSGKLICCTNVPWNSSWSNRNLSEIWDNMTWLQWDKEISNYTQIIYGLLEESQN
BG505_SOSIP_MD39_VLC2-04   VLAVEHYLRDQQLLGIWGCSGKLICCTNVPWNSSWSNRNLSEIWDNMTWLQWDKEISNYTQIIYGLLEESQN
BG505_SOSIP_MD39_VLC2-08   VLAVEHYLRDQQLLGIWGCSGKLICCTNVPWNSSWSNRNLSEIWDNMTWLQWDKEISNYTQIIYGLLEESQN
BG505_SOSIP_MD39_VLC3-13   VLAVEHYLRDQQLLGIWGCSGKLICCTNVPWNSSWSNRNLSEIWDNMTWLQWDKEISNYTQIIYGLLEESQN

BG505_SOSIP_D664_MD39      QQEKNEQDLLALD
BG505_SOSIP_MD39_VLC1-03   QQEKNEQDLLALD
BG505_SOSIP_MD39_VLC2-04   QQEKNEQDLLALD
BG505_SOSIP_MD39_VLC2-08   QQEKNEQDLLALD
BG505_SOSIP_MD39_VLC3-13   QQEKNEQDLLALD
```

FIG. 14B

| Position | N332-epitope Diversity |
|---|---|
| 156 | N(97%) |
| 158 | S(89%), T(10%) |
| 295 | N(86%), V(13%) |
| 297 | T(81%), I(12%) |
| 299 | P(98%) |
| 301 | N(95%) |
| 303 | T(94%) |
| 320 | T(90%) |
| 321 | G(79%) |
| 322 | D(49%), E(22%) |
| 323 | I(85%) |
| 324 | G(98%) |
| 325 | D(80%), N(16%) |
| 326 | I(96%) |
| 327 | R(98%) |
| 328 | Q(65%), K(24%) |
| 330 | H(66%), Y(31%) |
| 332 | N(72%), E(12%) |
| 334 | S(67%), N(29%) |
| 386 | N(90%) |
| 388 | T(48%), S(48%) |
| 389 | Q(26%), K(25%), G(19%) |
| 392 | N(92%) |
| 394 | T(79%) |
| 416 | T(71%), I(22%) |
| 417 | P(79%), Q(16%) |
| 419 | R(81%), K(18%) |
| 442 | N(27%), Q(22%) |
| 444 | T(29%), R(29%), N(20%) |

FIG. 14C

A. Binding to bnAbs assessed by SPR

| KD (nM) | V1V2 apex | | N332 supersite | | CD4 binding site | | gp120-gp41 interface |
|---|---|---|---|---|---|---|---|
| V3 stabilized trimers | PGDM 1400 | PGT 145 | PGT 121 | PGT 128 | VRC01 | 3BNC60 | PGT 151 |
| BG505 SOSIP.664 | 6 | 15 | 26 | 8 | 131 | 137 | 10 |
| BG505 MD39 | 12 | 20 | 21 | 11 | 124 | 189 | 11 |
| BG505 Olio6 | 19 | 31 | 15 | 8 | 90 | 119 | 18 |

B. Binding to non-nAbs assessed by SPR

E. Binding to CD4 assessed by SPR

F. Binding to human CD4+ T cells assessed by cytometry

A. Binding KDs for bnAbs from SPR, and melting temperatures (TM)

| Strain | Stabilization | Clade | V1V2 apex | | N332 supersite | | CD4 binding site | | | gp120-gp41 interface | TM |
|---|---|---|---|---|---|---|---|---|---|---|---|
| | | | PGDM 1400 | PGT 145 | PGT 121 | PGT 128 | VRC01 | 12A12 | 3BNC60 | PGT 151 | |
| BG505 | SOSIP.664 | A | 6 | 15 | 22 | 17 | 131 | 97 | 137 | 10 | 66 |
| | MD37 | A | | | | | 19 | 106 | 189 | | 80 |
| | MD39 | A | 12 | 20 | 21 | 18 | 124 | 67 | 121 | 11 | 77 |
| | Olio6 | A | 18 | 31 | 15 | 11 | 90 | 40 | 119 | | 76 |
| | MD39C | A | | | | 14 | | 71 | 144 | | 83.5 |
| | MD53 | A | 11 | 22 | | | | | | | 76 |
| 191084 | MD39 | A1 | 14 | 11 | 26 | 25 | 162 | 77 | 178 | | |
| AC10 | MD39 | B | | 9 | 169 | 33 | | 277 | | | 60 |
| | Olio6 | B | | 53 | | | | | | | 59 |
| 001428 | MD39 | C | | 43 | 16 | 42 | 80 | 55 | 74 | | |
| 841 | MD39 | B | | 6 | | | | | | | |
| ZM197 | MD39 | C | | 191 | | | | | | | |

FIG. 16A

C. Expression levels

D. Example of Application: blocking off-target antibodies

- VRC01-gH KI mouse
- GT8, core-boost, 2x trimer boost

A. Binding of bNAbs to constructs with native transmembrane domains assessed by flow cytometry B. Binding of bNAbs to constructs anchored via a flexible linker and PDGFR transmembrane domain assessed by flow cytometry

IMMUNOGENIC TRIMERS

RELATED APPLICATIONS AND INCORPORATION BY REFERENCE

This application is a continuation-in-part of international application Serial No. PCT/US2017/023854 filed Mar. 23, 2017, which published as PCT Publication No. WO 2017/165674 on Sep. 28, 2017, which claims benefit of and priority to U.S. provisional patent application Ser. No. 62/312,190 filed Mar. 23, 2016 and Ser. No. 62/384,762 filed Sep. 8, 2016.

All documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

FEDERAL FUNDING LEGEND

This invention was made with government support under Grant Nos. CHAVI-ID 1UM1AI100663 and R01 AI084817 awarded by the National Institute of Allergy and Infectious Disease. This invention was also made with government support under Grant No. P41GM103393 awarded by the National Institutes of Health, National Institute of General Medical Sciences. The government has certain rights in the invention.

SEQUENCE LISTING

The instant application contains a Sequence Listing which has been submitted electronically in ASCII format and is hereby incorporated by reference in its entirety. Said ASCII copy, created on May 5, 2017, is named 43094_99_2041_SL.txt and is 680,679 bytes in size

FIELD OF THE INVENTION

The invention relates to PGT121-germline-targeting designs, trimer stabilization designs, combinations of those two, trimers designed with modified surfaces helpful for immunization regimens, other trimer modifications and on development of trimer nanoparticles and membrane-bound trimers.

BACKGROUND OF THE INVENTION

AIDS, or Acquired Immunodeficiency Syndrome, is caused by human immunodeficiency virus (HIV) and is characterized by several clinical features including wasting syndromes, central nervous system degeneration and profound immunosuppression that results in opportunistic infections and malignancies. HIV is a member of the lentivirus family of animal retroviruses, which include the visna virus of sheep and the bovine, feline, and simian immunodeficiency viruses (SIV). Two closely related types of HIV, designated HIV-1 and HIV-2, have been identified thus far, of which HIV-1 is by far the most common cause of AIDS. However, HIV-2, which differs in genomic structure and antigenicity, causes a similar clinical syndrome.

An infectious HIV particle consists of two identical strands of RNA, each approximately 9.2 kb long, packaged within a core of viral proteins. This core structure is surrounded by a phospholipid bilayer envelope derived from the host cell membrane that also includes virally encoded membrane proteins (Abbas et al., Cellular and Molecular Immunology, 4th edition, W.B. Saunders Company, 2000, p. 454). The HIV genome has the characteristic 5'-LTR-Gag-Pol-Env-LTR-3' organization of the retrovirus family. Long terminal repeats (LTRs) at each end of the viral genome serve as binding sites for transcriptional regulatory proteins from the host and regulate viral integration into the host genome, viral gene expression, and viral replication.

The HIV genome encodes several structural proteins. The gag gene encodes structural proteins of the nucleocapsid core and matrix. The pol gene encodes reverse transcriptase (RT), integrase (IN), and viral protease (PR) enzymes required for viral replication. The tat gene encodes a protein that is required for elongation of viral transcripts. The rev gene encodes a protein that promotes the nuclear export of incompletely spliced or unspliced viral RNAs. The vif gene product enhances the infectivity of viral particles. The vpr gene product promotes the nuclear import of viral DNA and regulates G2 cell cycle arrest. The vpu and nef genes encode proteins that down regulate host cell CD4 expression and enhance release of virus from infected cells. The env gene encodes the viral envelope glycoprotein that is translated as a 160-kilodalton (kDa) precursor (gp160) and cleaved by a cellular protease to yield the external 120-kDa envelope glycoprotein (gp120) and the transmembrane 41-kDa envelope glycoprotein (gp41), which are required for the infection of cells (Abbas et al., Cellular and Molecular Immunology, 4th edition, W.B. Saunders Company, 2000, pp. 454-456). gp140 is a modified form of the Env glycoprotein, which contains the external 120-kDa envelope glycoprotein portion and the extracellular part of the gp41 portion of Env and has characteristics of both gp120 and gp41. The nef gene is conserved among primate lentiviruses and is one of the first viral genes that is transcribed following infection. In vitro, several functions have been described, including down-regulation of CD4 and MHC class I surface expression, altered T-cell signaling and activation, and enhanced viral infectivity.

HIV infection initiates with gp120 on the viral particle binding to the CD4 and chemokine receptor molecules (e.g., CXCR4, CCR5) on the cell membrane of target cells such as CD4+ T-cells, macrophages and dendritic cells. The bound virus fuses with the target cell and reverse transcribes the RNA genome. The resulting viral DNA integrates into the cellular genome, where it directs the production of new viral RNA, and thereby viral proteins and new virions. These virions bud from the infected cell membrane and establish productive infections in other cells. This process also kills the originally infected cell. HIV can also kill cells indirectly because the CD4 receptor on uninfected T-cells has a strong affinity for gp120 expressed on the surface of infected cells. In this case, the uninfected cells bind, via the CD4 receptor-gp120 interaction, to infected cells and fuse to form a syncytium, which cannot survive. Destruction of CD4+T-lymphocytes, which are critical to immune defense, is a major cause of the progressive immune dysfunction that is the hallmark of AIDS disease progression. The loss of CD4+ T cells seriously impairs the body's ability to fight most invaders, but it has a particularly severe impact on the defenses against viruses, fungi, parasites and certain bacteria, including mycobacteria.

Viruses have evolved a variety of mechanisms to escape antibody recognition, many of which involve features of the viral surface proteins, such as high variability, steric occlusion, and glycan coating. For HIV, the dense shield of glycans that decorate the viral Env protein was once believed to be refractory to antibody recognition, shielding conserved protein epitopes of important functional significance whose greater exposure would result in increased susceptibility to antibody neutralization.

Citation or identification of any document in this application is not an admission that such document is available as prior art to the present invention.

SUMMARY OF THE INVENTION

The invention relates to PGT121-germline-targeting designs, trimer stabilization designs, combinations of those two, trimers designed with modified surfaces helpful for immunization regimens, other types of trimer modifications (see, for example, IV: Examples of trimers with combined germline-targeting mutations and stabilization mutations and VI: Additional trimer modifications that add functionality and that can be combined with other types of modifications as described herein) and on development of trimer nanoparticles and membrane-bound trimers. The invention also encompasses combinations of any of the herein described modifications, such as but not limited to, combinations of stabilization and modified surfaces with nanoparticles or membrane-bound trimers.

The HIV envelope protein trimer is the target of broadly neutralizing antibodies (bNAbs). The high mannose patch, including the N332-linked glycan at the base of the V3 loop of gp120, is frequently targeted by bnAbs during natural infection and hence is an appealing vaccine epitope. Germline targeting has potential to initiate the elicitation of N332-dependent bnAbs by vaccination, but no immunogen has been reported to bind germline-reverted precursors of N332-dependent bnAbs.

PGT121 is one of the most broad and potent of the N332-dependent bnAbs. A structural comparison of the mature PGT121 bnAb with its germline-reverted precursors suggested structural regions in BG505 SOSIP that should be modified to generate affinity for the germline. Guided by this structural analysis, Applicants employed mammalian cell surface display to engineer BG505 SOSIP trimer variants with appreciable affinity for germline-reverted PGT121. In the process of developing the germline-targeting immunogen, Applicants produced a series of less mutated trimer immunogens with varying affinities for germline PGT121 and for partially mutated variants of PGT121. Informed by the binding affinities and structural features of the intermediate immunogens, Applicants then postulated sequences of boosting immunogens to guide maturation along different paths following germline activation.

The invention also encompasses a protein having at least 90% homology or identity with the sequence of the protein of any one of the trimers disclosed herein. The invention also encompasses a protein having at least 95% homology or identity with the sequence of the protein of any one of trimers disclosed herein.

The invention also encompasses any nucleic acid encoding the protein of any one of the trimers disclosed herein. The invention also encompasses a nucleic acid having at least 90% or 95% homology or identity with the sequence of said nucleic acid.

The present invention also encompasses methods for eliciting an immune response which may comprise systemically administering to an animal in need thereof an effective amount of the protein of any one of the trimers disclosed herein. The animal may be a mammal, advantageously a human.

Accordingly, it is an object of the invention not to encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any previously described product, process of making the product, or method of using the product. It may be advantageous in the practice of the invention to be in compliance with Art. 53(c) EPC and Rule 28(b) and (c) EPC. Nothing herein is to be construed as a promise.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

These and other embodiments are disclosed or are obvious from and encompassed by, the following Detailed Description.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

The following detailed description, given by way of example, but not intended to limit the invention solely to the specific embodiments described, may best be understood in conjunction with the accompanying drawings.

FIG. 1 depicts a mammalian display/directed evolution overview.

Figure 2:
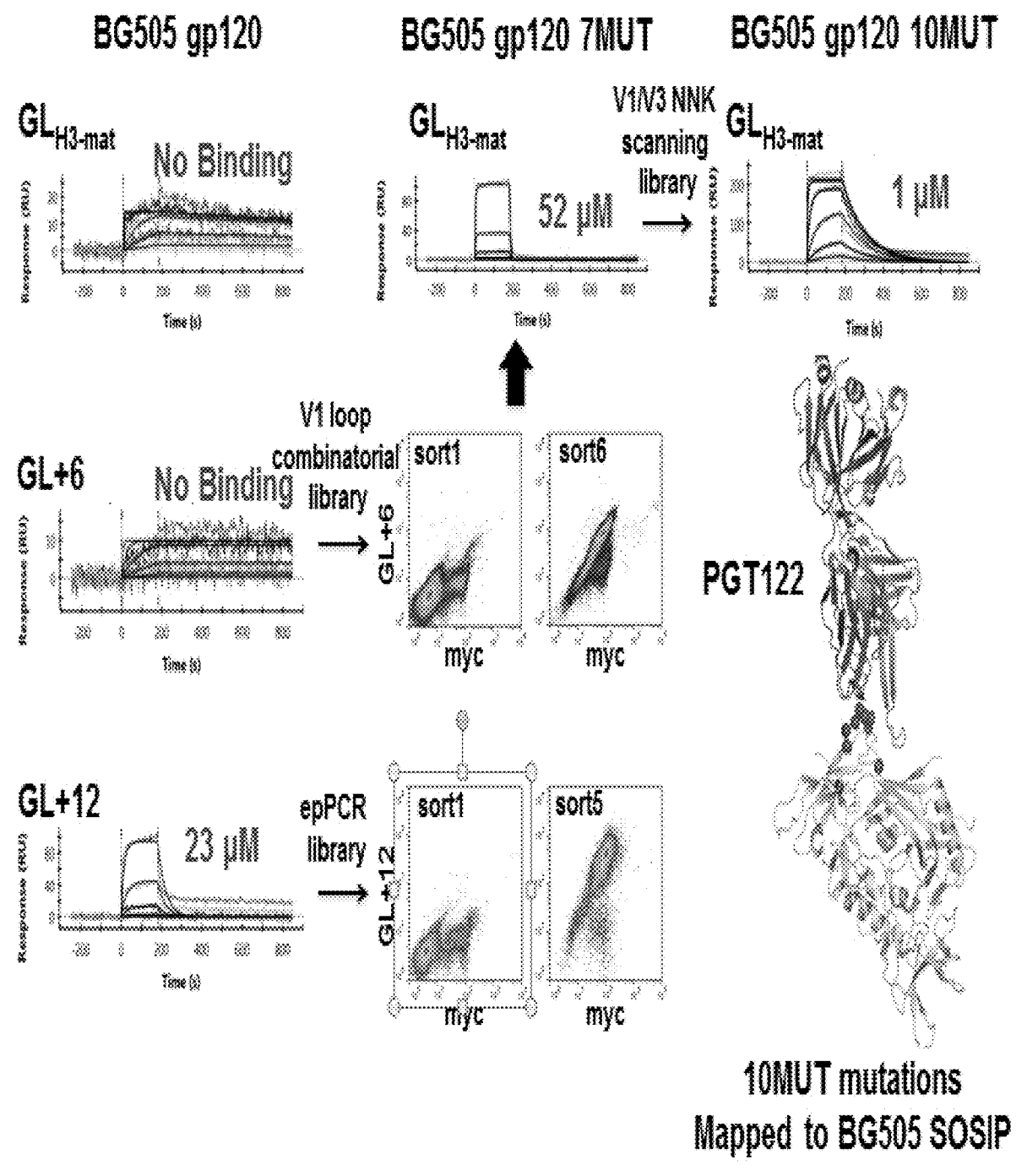

FIG. 2 depicts a mammalian display strategy using partially mutated PGT121 intermediate antibodies FIG. 3 depicts binding affinities (SPR Kd (nM)) of germline-targeting gp120s (monomeric gp120 used for SPR, but SOSIP used for immunization) NB, no binding; NB**, no binding at 150 uM.

FIG. 4 depicts biophysical properties of a SOSIP trimer engineered by mammalian display directed evolution and having improved thermostability, yield and antigenic profile. A BG505 SOSIP trimer whole gene saturation mutagenesis library was FACS sorted on the surface of mammalian cells for reduced binding to B6 and 4025 and enhanced binding to PGT145 and PGT151. Additional combinatorial libraries based on the initial screen as well as an Env sequence alignment were sorted by the same method. This resulted in BG505 SOSIP-MD39 which contained 11 mutations and had improved expression and thermostability while maintaining a native-like antigenic profile. V3 mAb SPR was measured with IgG as the ligand and trimer as the analyte to allow avidity for maximum sensitivity, whereas bnAb Kds were measured as monovalent interactions. These stabilizing mutations were combined with PGT121 germline-targeting mutations to make native-like trimers with enhanced stability that engage PGT121 germline precursors.

Figure 5:
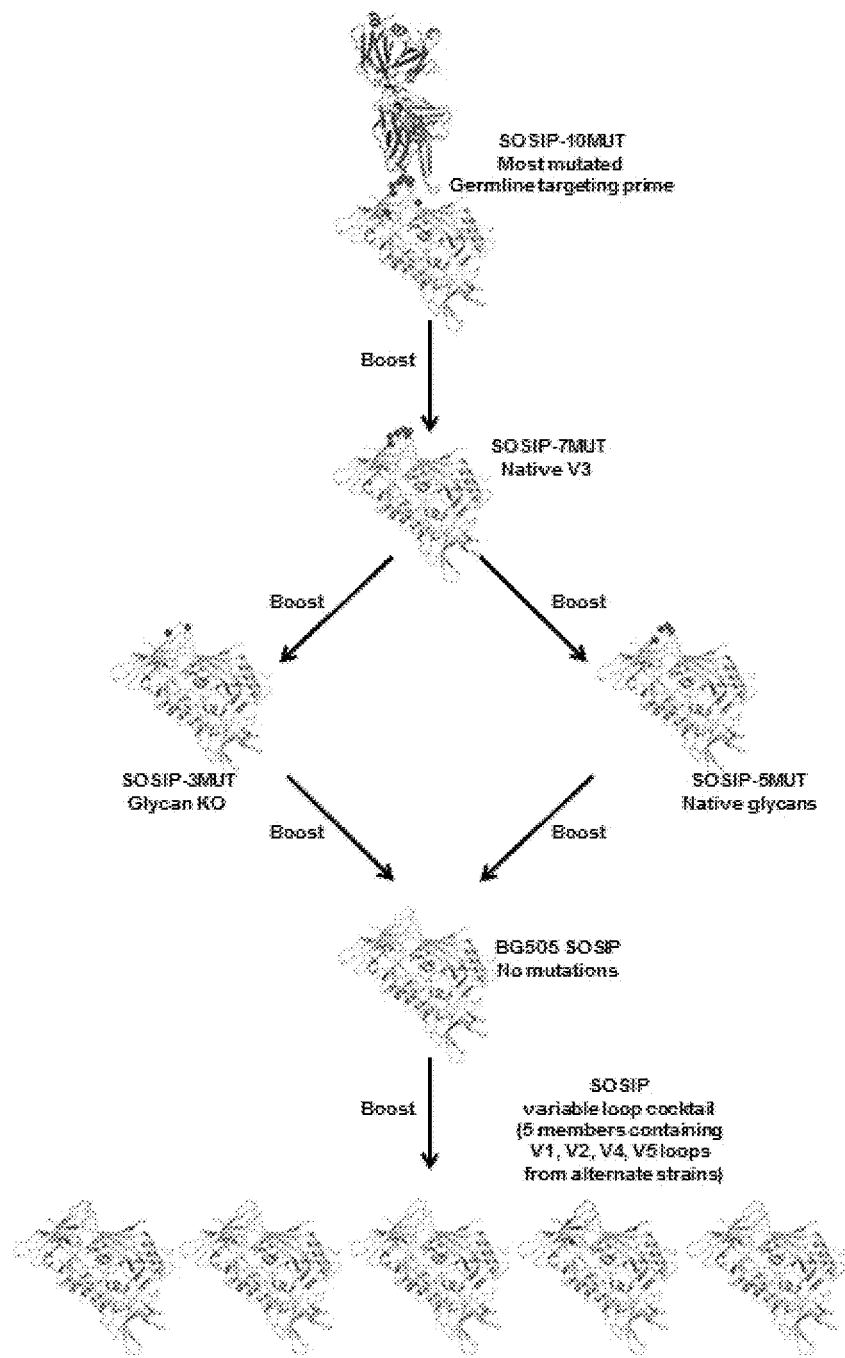

FIG. 5 depicts postulated sequences of boosting immunogens to guide maturation along different paths following germline activation.

Figures 6A, 6B:
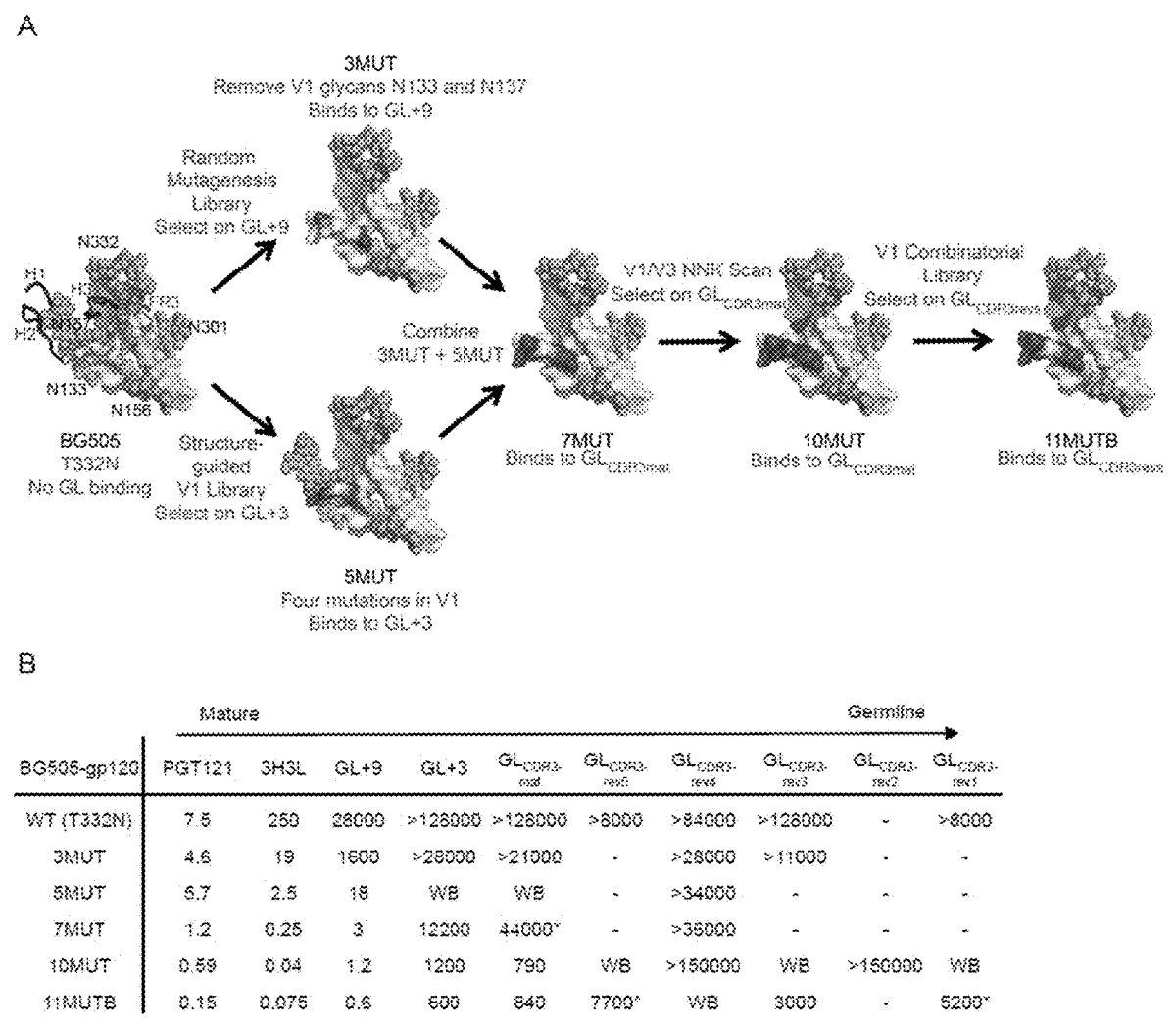

FIG. 6A-6B depicts a mammalian display-directed evolution design pathway for PGT121 germline-targeting Env-based immunogens. (FIG. 6A) Models of the PGT121 epitope are shown for each immunogen, with positions of germline-targeting mutations colored red and glycans depicted with cyan spheres. The epitope of BG505 is colored yellow (variable loop 1) and pink (variable loop 3). The paratope of PGT122 is mapped onto the epitope of BG505 and shown in tube representation (heavy chain in blue, light chain purple) (FIG. 6B) Binding KDs of mature, intermediately mutated and germline-reverted variants of PGT121 for BG505-gp120 and germline-targeting gp120s, determined by SPR. SPR $K_D$s are the average of two or three experiments. *Indicates complex binding kinetics. WB, weak binding; (−), not done.

Figure 7A:
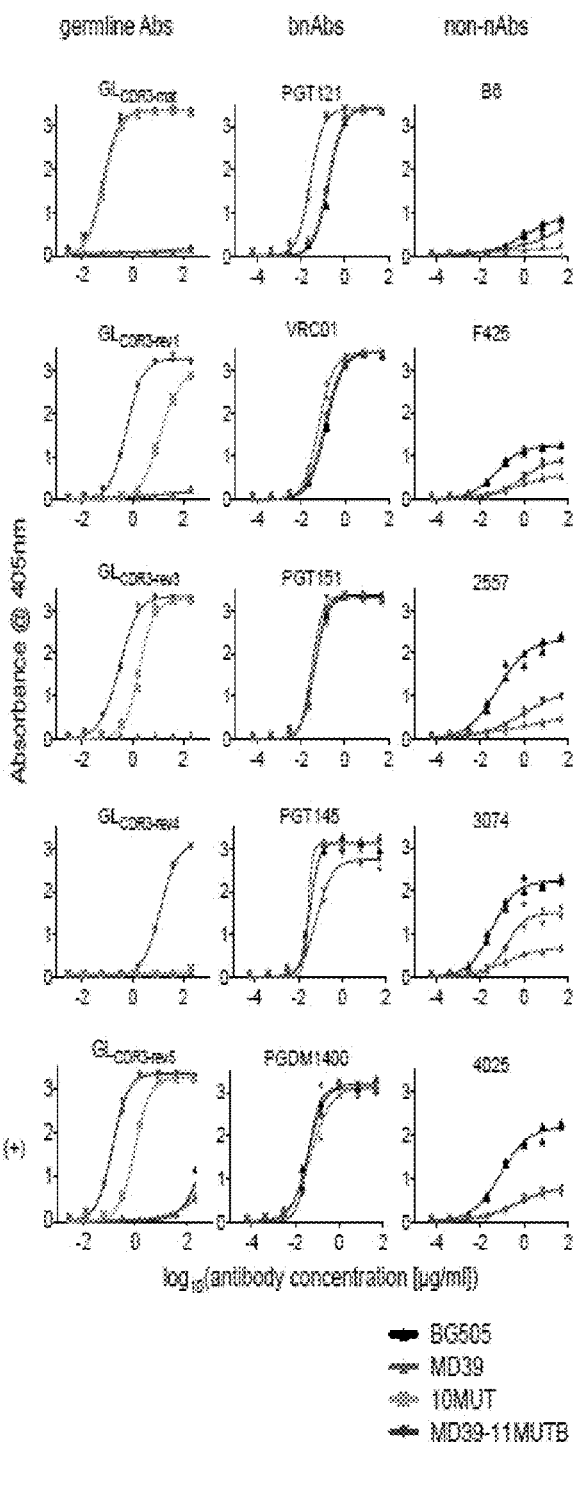
Figure 7B:
Figure 7C:
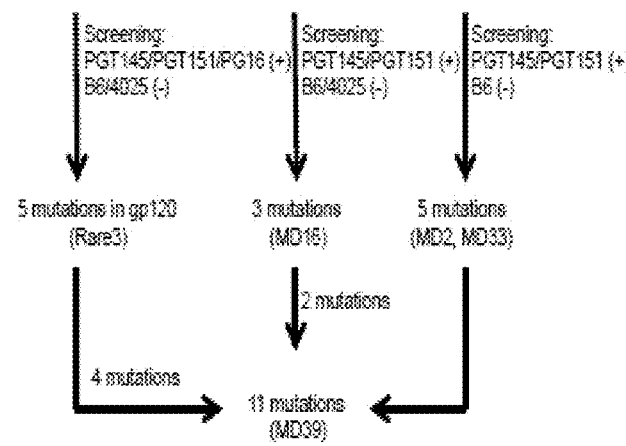

FIG. 7A-7C depicts a design of mutations to stabilize BG505-SOSIP and germline-targeting native-like trimers. (FIG. 7A) Biophysical properties of stabilized BG505-SOSIP and germline-targeting trimers. Antigenic profile was assessed by SPR, thermostability measurements were made by DSC, and expression was determined as yield of purified protein relative to BG505-SOSIP made with PEI or 293Fectin transfection reagents in 293F cells. Monovalent KDs were measured by SPR with trimer ligand and Fab analyte except for PGT145 and PGDM1400, for which monovalent KDs were determined with IgG ligand and trimer analyte. For PGT151, a 1-to-1 binding model gave a relatively poor kinetic fit. (FIG. 7B) Antigenic profile of stabilized BG505-SOSIP and germline-targeting trimers by ELISA. Data are representative of two independent experiments, each done in duplicate. (FIG. 7C) Mammalian display-directed evolution design pathways for engineering stabilized native-like trimers.

FIG. 8A-8F depicts sequential boosting schemes employing a native-like trimer cocktail and germline-targeting design intermediates. (FIG. 8A) Side view of a single PGT122 Fab (light blue cartoon and semi-transparent surface) bound to the BG505 SOSIP native-like gp140 trimer, based on PDB ID: 4NCO. The PGT122-bound gp140 subunit is shown in wheat-colored cartoon; the V1, V2, V4, V5 variable loops on that subunit, modeled wherever missing in the crystal structure, are shown in yellow (V1), olive (V2), teal (V4), magenta (V5); the N332 glycan is shown as red spheres; and the two other gp140 subunits are shown as gray surfaces. (FIG. 8B) Same model as in (FIG. 8A), except that glycosylation sites on the trimer have been decorated with Man8GlcNAc2 glycans shown as spheres (V1 glycans, red; V2 glycans, olive; V4 glycans, teal; N156 glycan, magenta; N332 glycan, red; all other glycans, gray), and all trimer subunits are gray surface. (FIG. 8C) Two-dimensional histogram of variable loop (V1, V2, V4, V5) length and number of glycosylation sites among 3,897 unique HIV Env sequences isolated from infected individuals obtained from www.hiv.lanl.gov. Frequency is indicated by the color scale shown for each loop. The length and number of glycosylation sites for each loop of the native-like VLC trimers are indicated. Further elaboration of this cocktail could include accounting for sequence variation at non-variable-loop positions within the N332-epitope region (FIG. 14C). (FIG. 8D) Basic scheme in which a germline-targeting prime (10MUT or 11MUT$_B$) is boosted by a native-like trimer (BG505) and then by a cocktail of native-like trimers. (FIG. 8E) Diagram illustrating seven boosting schemes employing germline-targeting design intermediates (7MUT, 6MUT, 5MUT, 3MUT) as boosts after a germline-targeting prime and before a native-like trimer; the scheme in A is included for reference. Relative affinity drops (in fold affinity decrease) for each boost, computed from FIG. 6B as described in the text, are indicated as red numbers. (FIG. 8F) Linear diagrams of three of the best boosting schemes as ranked by favoring those with the smallest maximum affinity drop.

Figure 9A:
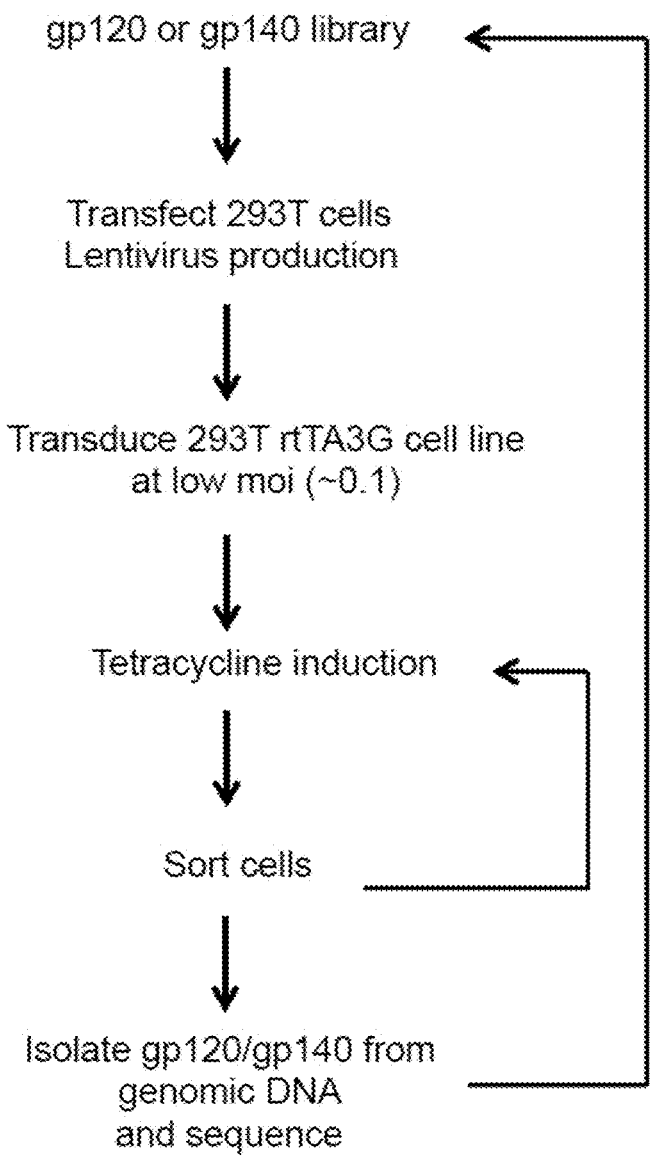
Figure 9B:
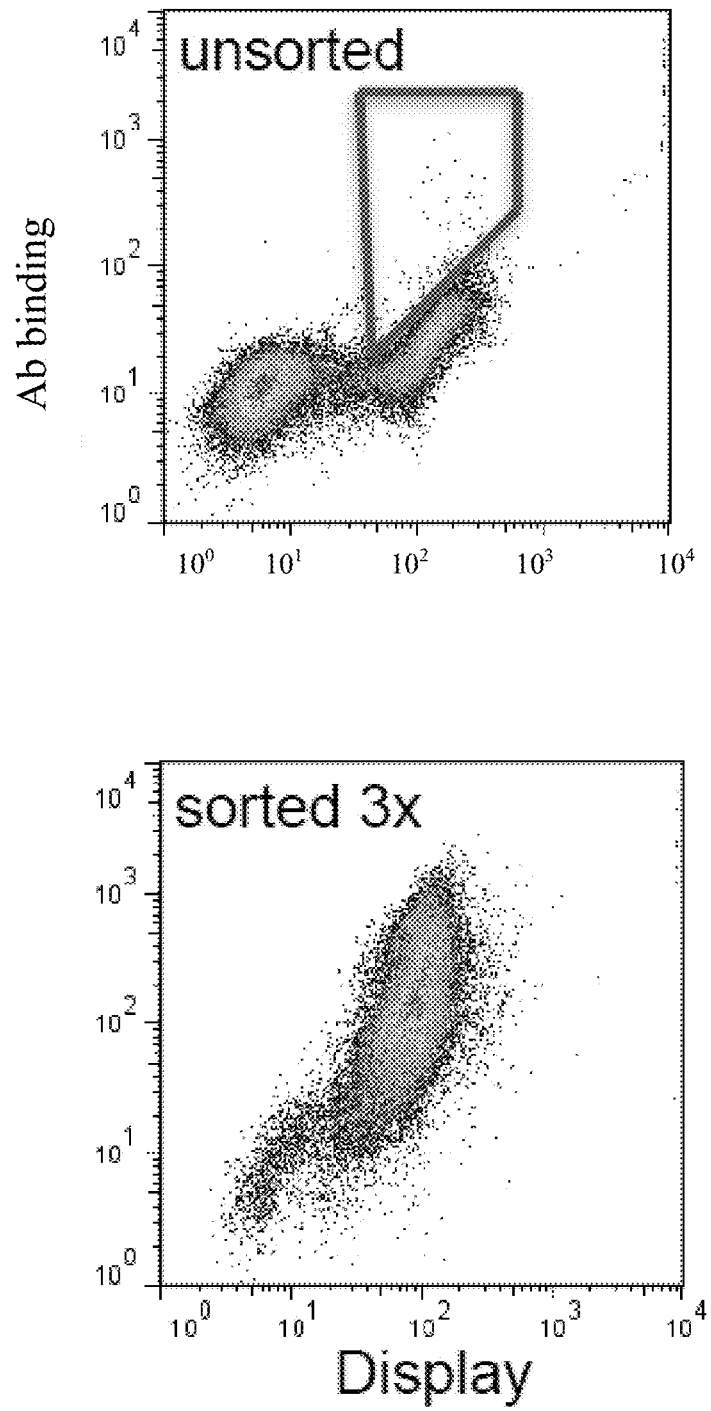

FIG. 9A-C depicts mammalian display overview related to FIG. 6. (FIG. 9A) Schematic of mammalian display procedure. (FIG. 9B) Example FACS plots for unsorted mammalian display library (top) and the same library sorted 3 times (bottom), see Extended Experimental Procedures. (FIG. 9C) Sequences of BG505-SOSIP (SEQ ID NO: 117) and BG505-gp120 (SEQ ID NO: 118) used for mammalian display. Leader peptides are shown in red, the cMyc epitope is shown in green and the PDGFR TM is shown in blue.

FIG. 10 depicts germline-reverted PGT121 Abs, related to FIG. 6. Sequences of PGT121 and germline reverted variants with mutations highlighted relative to germline V4-59/D3-3/J6 (heavy chain) and V3-21/J3 (light chain) genes. Figure discloses Heavy Chain sequences as SEQ ID NOS 119-128 and Light Chain sequences as SEQ ID NOS 129-138, all respectively, in order of appearance.

Figure 11:
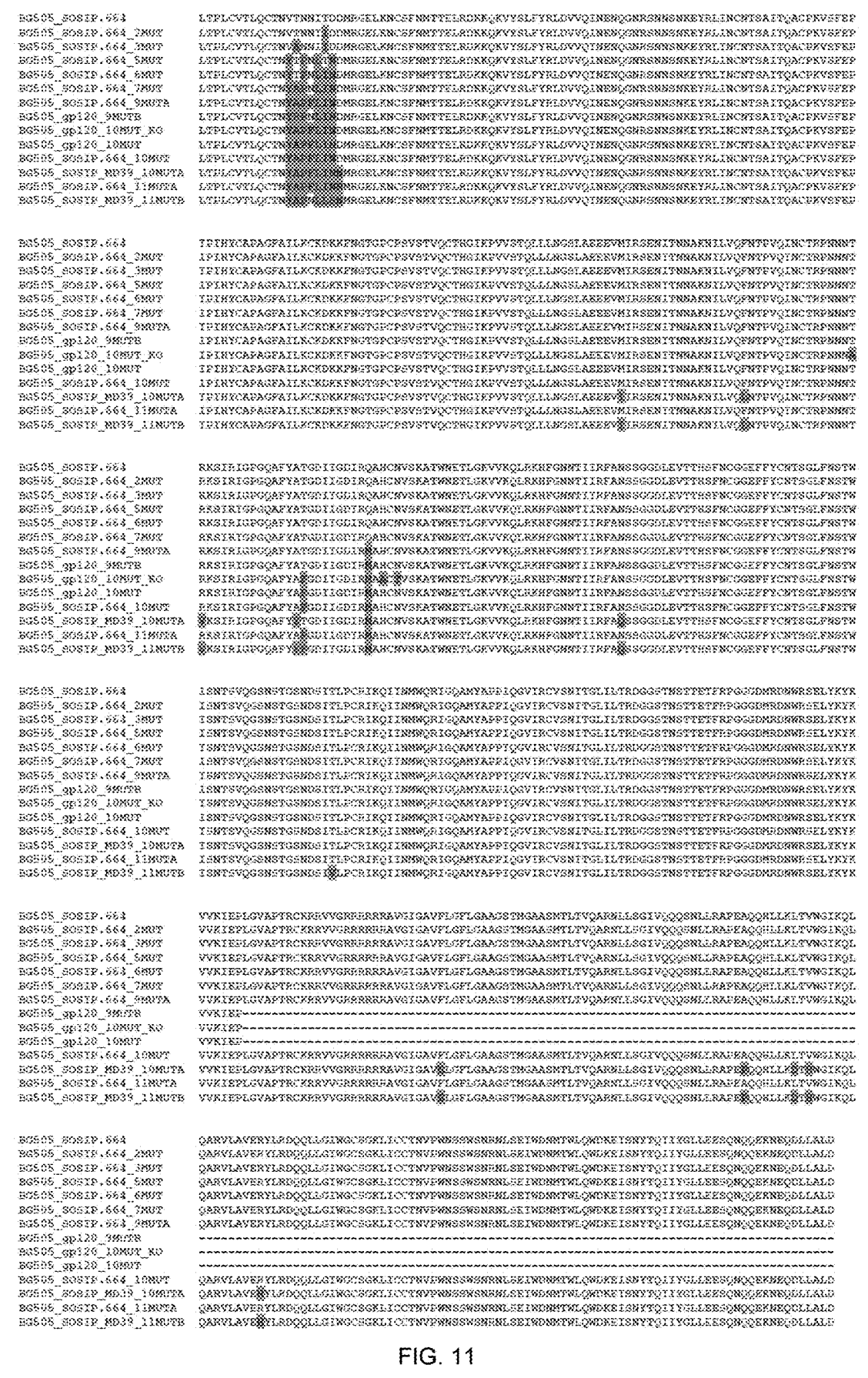

FIG. 11 depicts PGT121 germline targeting gp120s and gp140s, related to FIG. 6. Designed germline targeting trimer and gp120 sequences are shown with mutations from BG505-SOSIP highlighted. BG505-SOSIP.D664 contains the mutation T332N, not highlighted. Figure discloses SEQ ID NOS 139-152, respectively, in order of appearance.

Figures 12A, 12B:
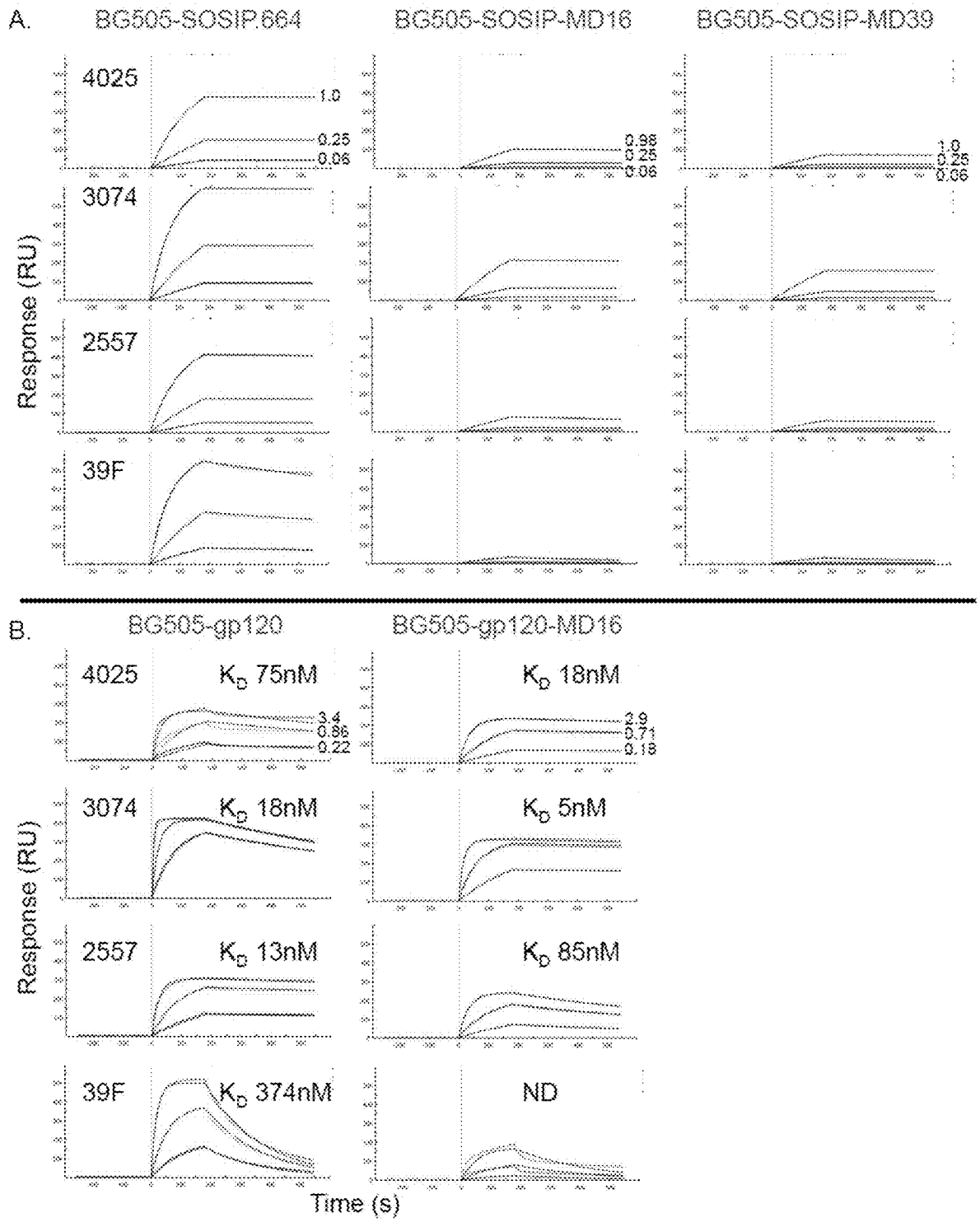

FIG. 12A-12B depicts SPR binding data for V3 Abs binding to gp140 SOSIPs and their matching gp120s, related to FIG. 7. (FIG. 12A) Comparison of V3 binding between WT BG505-SOSIP and BG505-SOSIP variants containing R304V and A319Y V3 mutations. For the 4025 SPR plots, the gp140 concentrations tested are shown in M next to each relevant sensogram and are equivalent for all V3 Abs tested. (FIG. 12B) Comparison of V3 binding to WT gp120 and gp120-MD16 containing the R304V and A319Y mutations. For the 4025 SPR plots, the gp120 concentrations tested are shown in M next to each relevant sensogram and are equivalent for all V3 Abs tested.

Figures 13B, 13C:
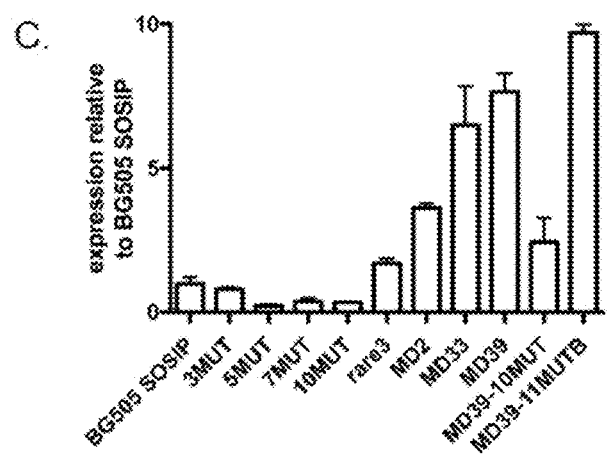

FIG. 13A-13C depicts trimers with improved thermostability, expression, or antigenic profile, related to FIG. 7. (FIG. 13A) Sequences of designed stabilized native-like trimers with mutations from BG505 SOSIP.D664 highlighted. Figure discloses SEQ ID NOS 153-158, respectively, in order of appearance. (FIG. 13B) Melting temperature of stabilized trimers as assessed by DSC. (FIG. 13C) Native-like trimers with and without stabilizing mutations were transiently transfected in 293F cells and expression levels were determined by capture ELISA using PGT145 Fab for immobilization and PGT151 IgG for detection. Values are the mean±SD of 3 replicate transfections.

FIG. 14A-14C depicts sequences and biophysical properties of the MD39-based VLC native-like trimer cocktail, and N332-epitope sequence diversity. (FIG. 14A) Biophysical characterization of the MD39-based VLC cocktail. (FIG. 14B) Sequences of MD39-based VLC cocktail members, with changes relative to MD39 highlighted in green. Figure discloses SEQ ID NOS 159-163, respectively, in order of appearance. (FIG. 14C) List of interface positions on the BG505 SOSIP trimer near N332-supersite bnAb epitopes (PGT122, PGT128, PGT135), showing the frequencies of the amino acids found at those positions in 10% or more of 3,897 unique HIV Env sequences isolated from infected individuals obtained from www.hiv.lanl.gov.

Figures 15A, 15B:
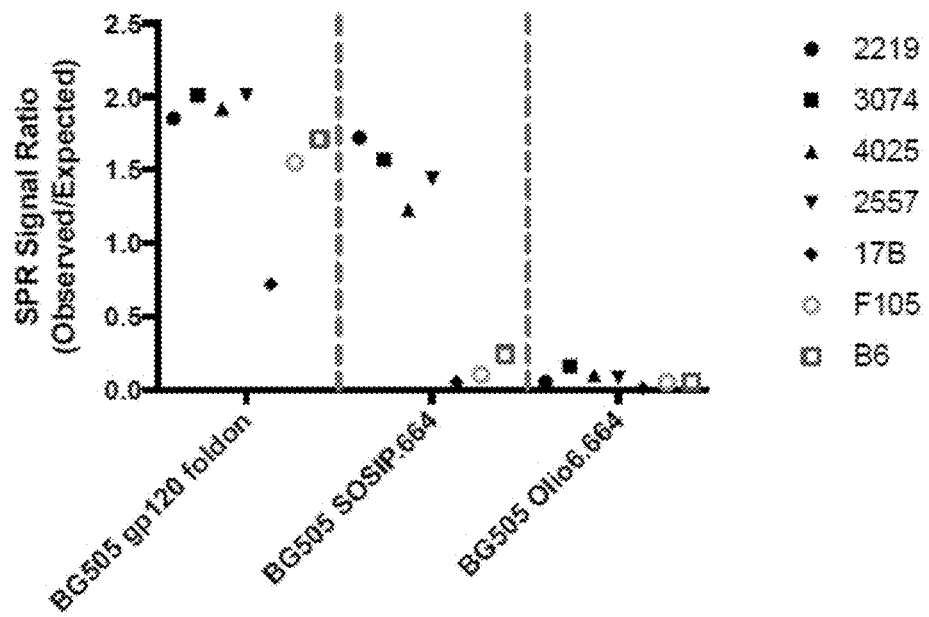
Figure 15C:
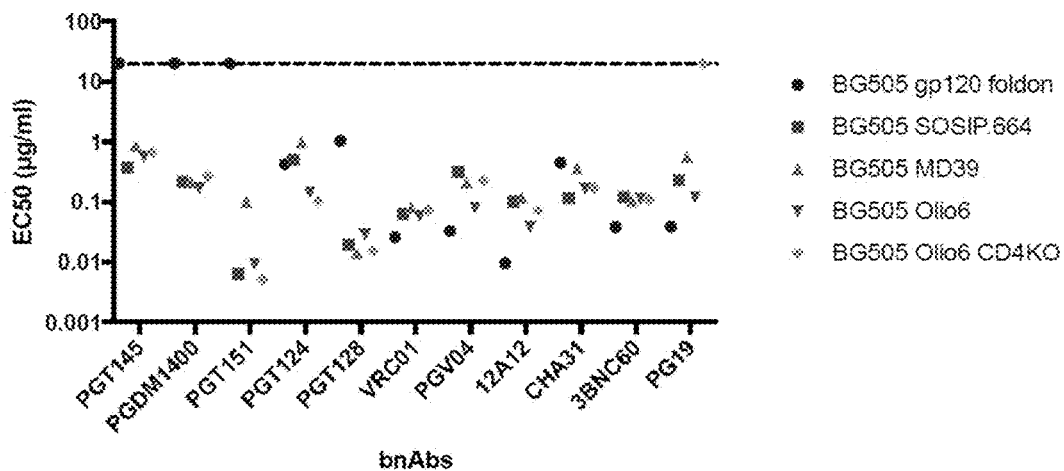
Figure 15D:
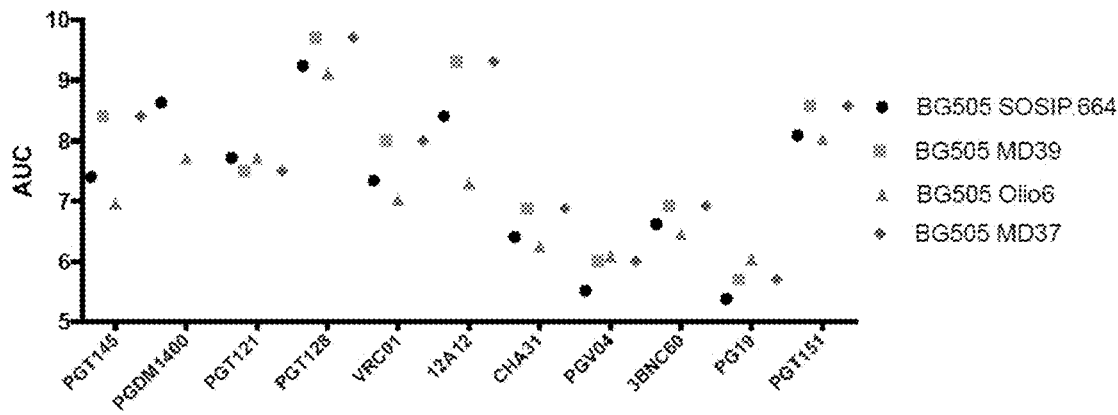
Figure 15E:
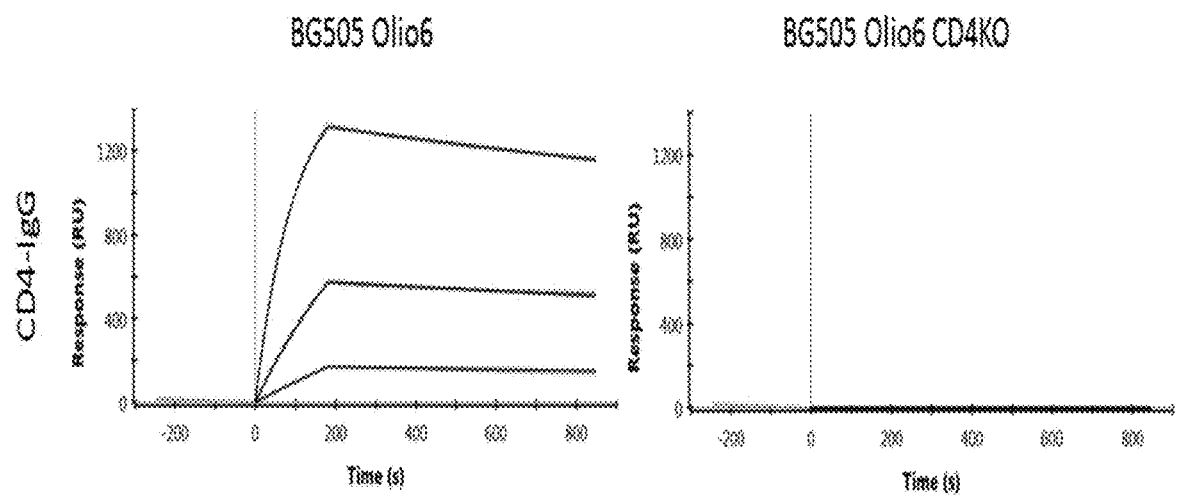
Figure 15F:
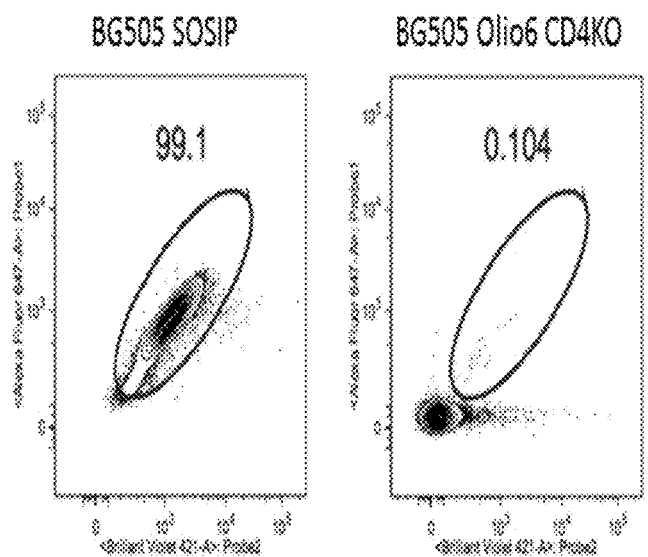
Figure 15G:
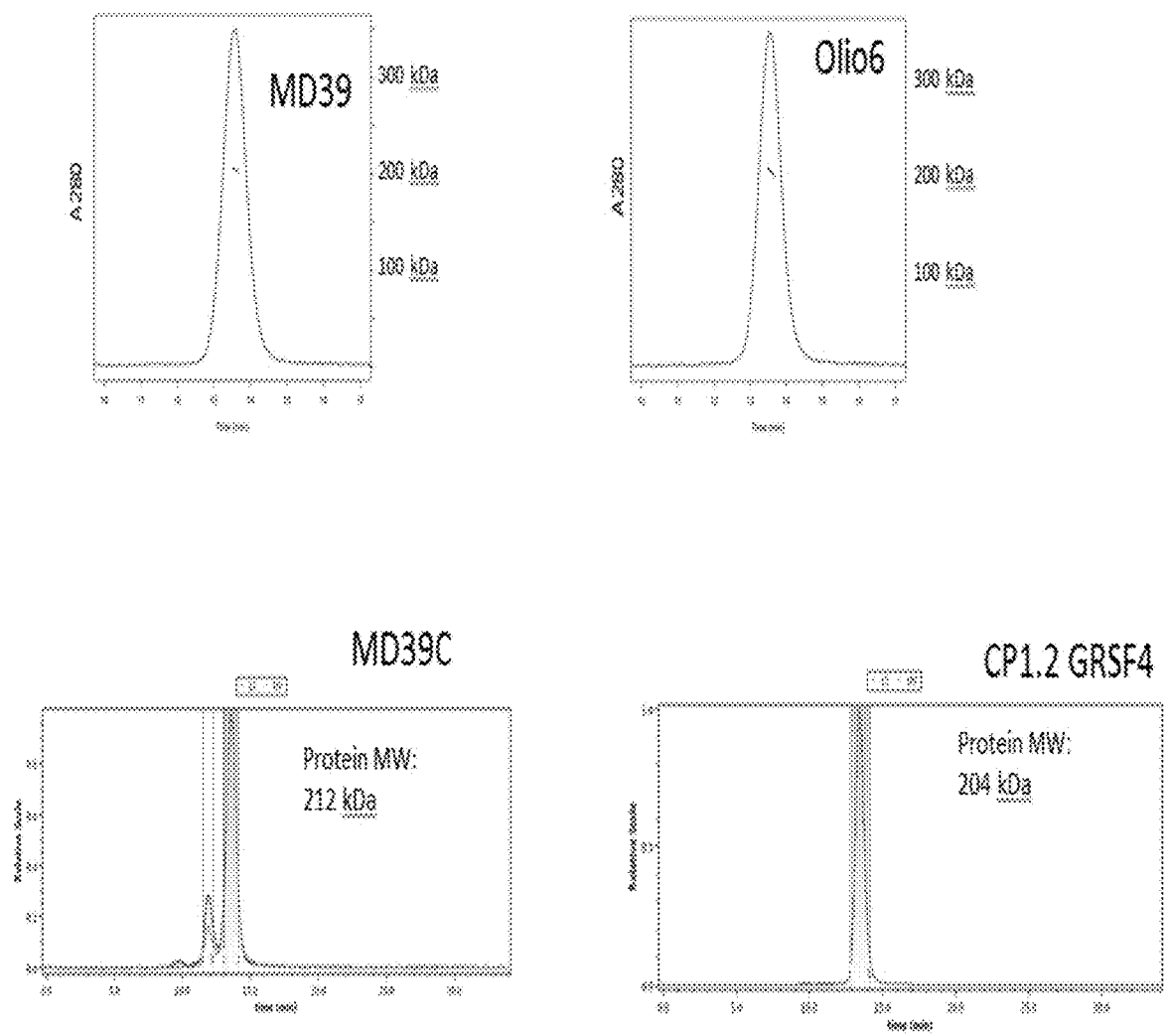

FIG. 15A-15G depicts properties of BG505 Olio6, Olio6 CD4KO, MD39 and MD37. FIG. 15A. Binding dissociation constants (KDs) measured by SPR for BG505 SOSIP, BG505 MD39 and BG505 Olio6 binding to various bnAbs. KDs were measured using trimer analyte and IgG captured on the sensor as ligand for V1V2 apex antibodies that bind as one Fab per trimer, but for other antibodies the KDs were measured with trimer captured as ligand and Fabs as analytes. FIG. 15B. Binding of the native-like trimers BG505 SOSIP and BG505 Olio6 and the non-native trimer BG505 gp120 foldon to multiple non-nAbs, assessed by SPR. Trimers were analytes and IgG were captured on the sensor chip as ligand. Binding was assessed at 1 uM trimer analyte concentration and is displayed as the ratio of the observed response units to the response units expected for a 1 to 1 binding interaction between each gp120 on the trimer and each Fab on the IgG. Lower values correspond to less binding. FIG. 15C. Binding of the native-like trimers BG505 SOSIP, BG505 MD39, BG505 Olio6 and BG505 Olio6 CD4KO, and the non-native trimer BG505 gp120 foldon, to various bnAbs assessed by ELISA and displayed as the antibody concentration that gives a half-maximal response (EC50). FIG. 15D. Binding of the native-like trimers BG505 SOSIP, BG505 MD39, BG505 Olio6 and BG505 MD37 to various bnAbs by ELISA and displayed as the area under the curve (AUC). FIG. 15E. Binding of BG505 Olio6 and BG505 Olio6 CD4KO to CD4-IgG assessed by SPR. CD4-IgG was captured on the sensor as ligand and trimers were analytes. No binding was detected for BG505 Olio6 CD4KO at a maximum trimer concentration of 1 uM. FIG. 15F. Binding of BG505 SOSIP and BG505 Olio6 CD4KO to human CD4+ T cells by flow cytometry. Trimers were labelled with two different fluorescent probes, cells were stained with trimers for 30 mins, and trimer-specific binding was detected as the percentage of cells in the double-positive population. 99.1% of cells bound to BG505 SOSIP but only 0.1% of cells bound to BG505 Olio6 CD4KO. FIG. 15G. Size exclusion chromatography coupled inline with multi-angle light scattering (SECMALS) analysis showing as examples that, in solution, BG505 MD39, BG505 Olio6, BG505 MD39c, and BG505 MD39 CP1.2 GRSF4 have the molecular weight expected of a trimer.

Figure 16B:
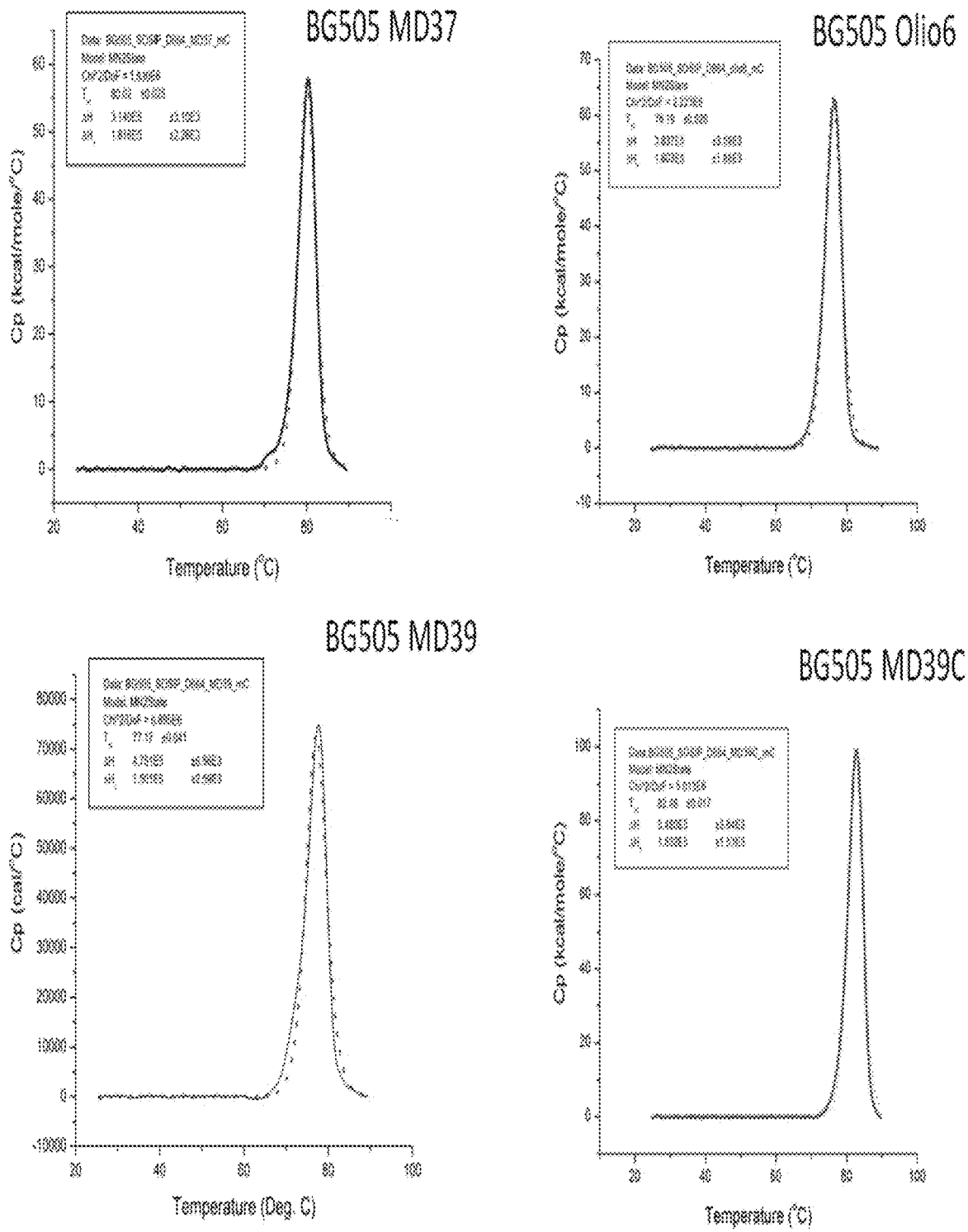
Figure 16C:
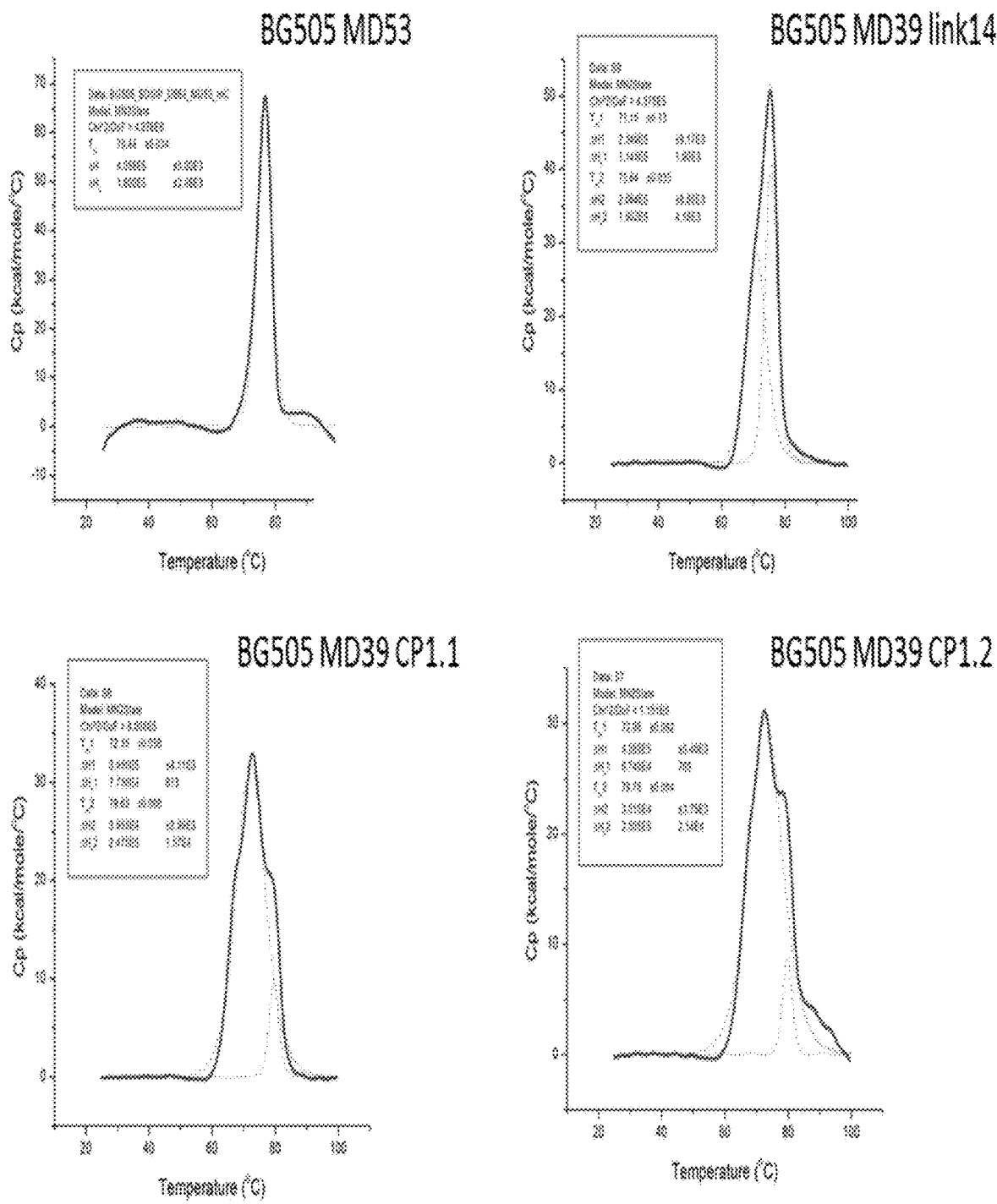

FIG. 16A-16C depicts biophysical properties of stabilized trimers for BG505 and other HIV strains. FIG. 16A. Binding dissociation constants (KDs) measured by SPR for multiple stabilized trimers binding to different bnAbs (PGDM1400, PGT145, PGT121, PGT128, VRC01, 12A12, 3BNC60 and PGT151). Also, the last column shows the melting temperature (TM) measured by differential scanning calorimetry (DSC). FIG. 16B. DSC melting data for BG505 MD37, BG505 MD39, BG505 Olio6 and BG505 MD39C. FIG. 16C. DSC melting data for BG505 MD53, BG505 MD39 CP1.1, BG505 MD39 CP1.2 and BG505 MD39 link14.

Figures 17A, 17B, 17C:
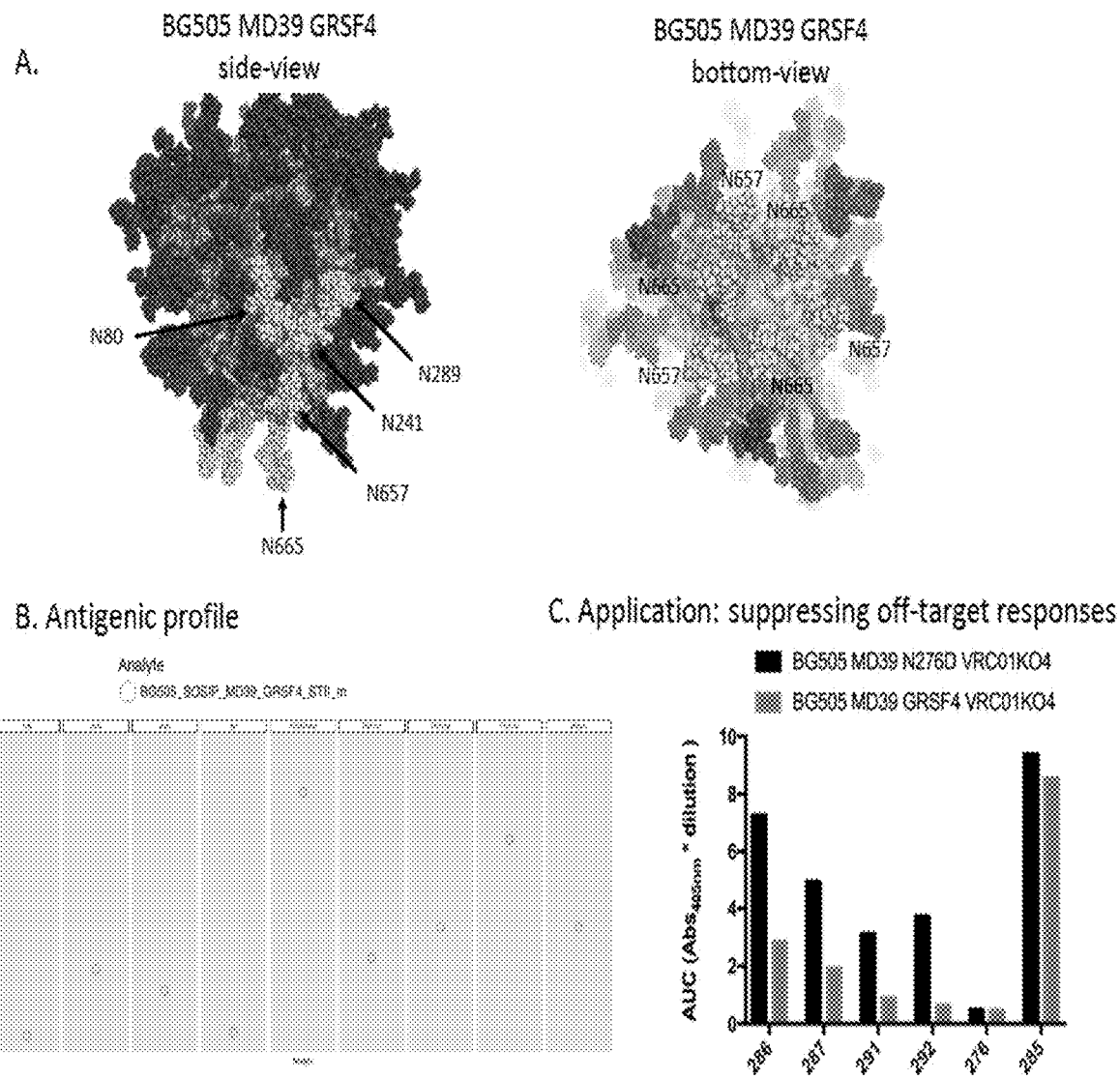

FIG. 17A-17C depicts properties of BG505 MD39 GRSF4. FIG. 17A. Side and Bottom views of a model of BG505 MD39 GRSF4, illustrating the locations of the five newly introduced glycosylation sites at positions 80, 241, 289, 657 and 665. Addition of these glycosylation sites is intended to mask an otherwise exposed surface on the soluble BG505 trimer, a surface that is not targeted by the classes of bnAbs Applicants aim to elicit against the CD4bs, V2 apex and N332 supersite. Positions 241 and 289 are glycosylation sites that are relatively conserved across HIV strains but are absent in BG505. Positions 80 and 657 are not glycosylation sites in 2869 HIV Env sequences Applicants examined, and 665 appears as a glycosylation site in 2 of 2869 sequences. FIG. 17B. Binding of the native-like trimer BG505 MD39 GRSF4 to various bnAbs and the non-nAbs 17b, 3074, 4025 and B6, assessed by SPR. Trimers were analytes and IgG were captured on the sensor chip as ligand. Binding was assessed at 1 uM trimer analyte concentration and is displayed as the ratio of the observed response units to the response units expected for a 1 to 1 binding interaction between each gp120 on the trimer and each Fab on the IgG. Lower values correspond to less binding. FIG. 17C. Data illustrating that the additional glycans present in MD39 GRSF4 serve to block undesired responses to soluble trimers. ELISA area under the curve (AUC) values are displayed for six VRC01 gH mice from Applicants' study in Briney et al. Cell 2016. These six mice received four immunizations: eOD-GT8 60mer, core N276D 60mer, and two shots of BG505 SOSIP N276D, and several of them developed VRCO1-class responses to the CD4 binding site. Serum from these mice were tested by ELISA for the capacity to bind to two variants of BG505 MD39 that each have mutations in the VRC01 epitope that abrogate VRC01-class binding ("KO4" mutations). Thus serum binding to these two variants report on the strength of off-target, non-VRCO1-class responses. This ELISA analysis shows that the sera from 4/6 mice show considerably stronger reactivity to BG505 MD39 N276D KO4 compared to BG505 MD39 GRSF4 KO4, demonstrating that a significant portion of the off-target response in these mice is directed to epitopes in the region masked by the additional GRSF4 glycans.

Figures 18A, 18B:
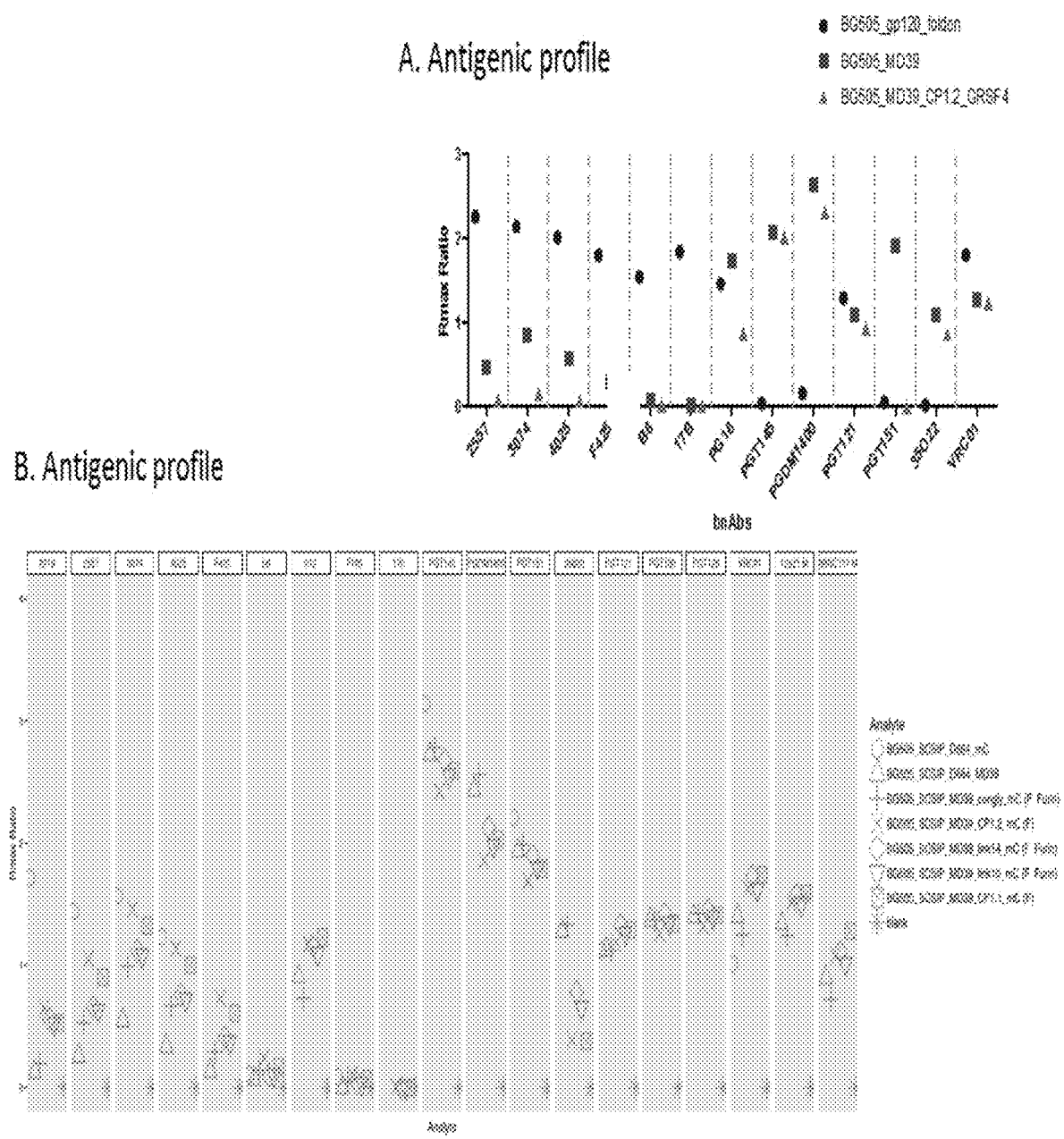
Figure 18C:
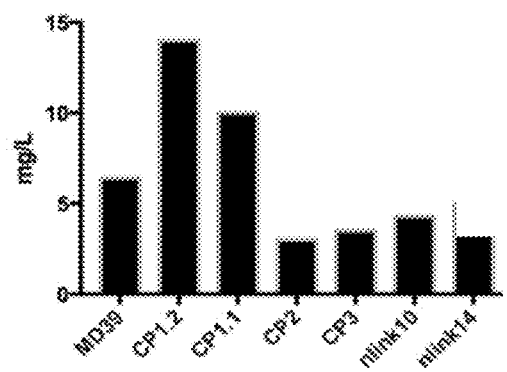
Figure 18D:
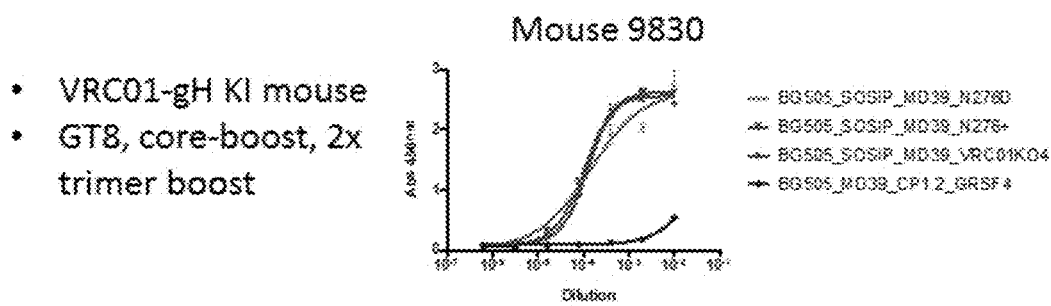

FIG. 18A-18D depicts properties of several cleavage-independent trimers. FIG. 18A. Antigenic profile of the cleavage-independent native-like trimer BG505 CP1.2 GRSF4 compared to the cleavage-depdendent native-like trimer BG505 MD39 and the non-native trimer BG505 gp120 foldon. Binding was assessed by SPR to various bnAbs and the non-nAbs 2557, 3074, 4025, F425, B6 and 17B. Trimers were analytes and IgG were captured on the sensor chip as ligand. Binding was assessed at 1 uM trimer analyte concentration and is displayed as the ratio of the observed response units to the response units expected for a 1 to 1 binding interaction between each gp120 on the trimer and each Fab on the IgG. Lower values correspond to less binding. FIG. 18B. Antigenic profiles of various cleavage-independent trimers compared to the cleavage-dependent trimers BG505 SOSIP, BG505 MD39 and BG505 MD39 congly, measured as in A. FIG. 18C. Expression levels of BG505 MD39 and various cleavage-independent trimers. Applicants reported in Steichen et al. that BG505 MD39 has a significantly higher expression level than BG505 SOSIP. FIG. 18D. Data illustrating that the circular permutation modification combined with the additional glycans present in MD39 CP1.2 GRSF4 serve to block undesired responses induced by soluble trimers. ELISA titrations are shown for a single VRC01 gH mice that received four immunizations: eOD-GT8 60mer, core N276D 60mer, and two shots of BG505 MD39 N276D. The mouse serum binds equally well to BG505 MD39 N276D (which has a native CD4 binding site and VRC01 epitope except for the elimination of the N276 glycan which improves VRC01-class binding) and BG505 MD39 VRC01KO4 (which has mutations in the VRC01 epitope that abrogate VRC01-class binding). Thus, the dominant serum response in this mouse is focused to off-target, non-VRCO10-class epitopes on the trimer. The serum shows very little reactivity to BG505 MD39 CP1.2

GRSF4, demonstrating that the modifications in this protein serve to block the majority of off-target responses in this mouse.

Figure 19A:
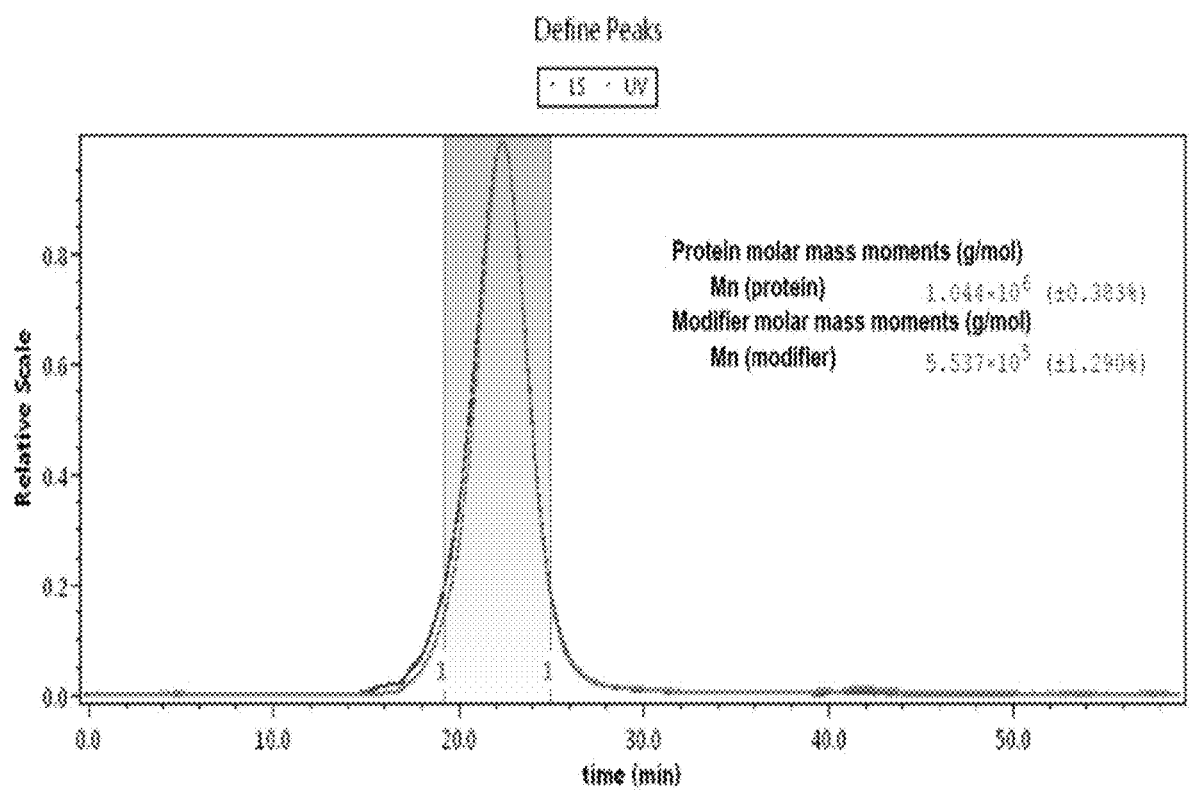
Figure 19B:
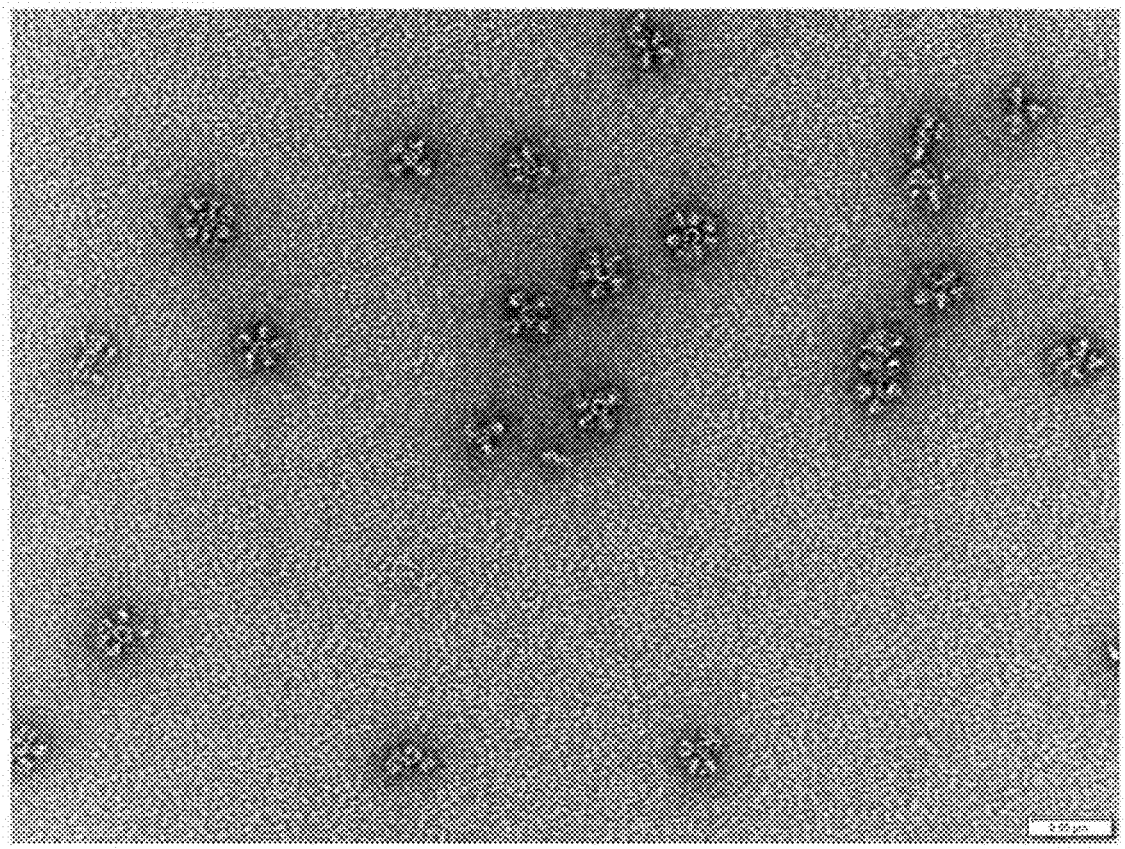
Figure 19C:
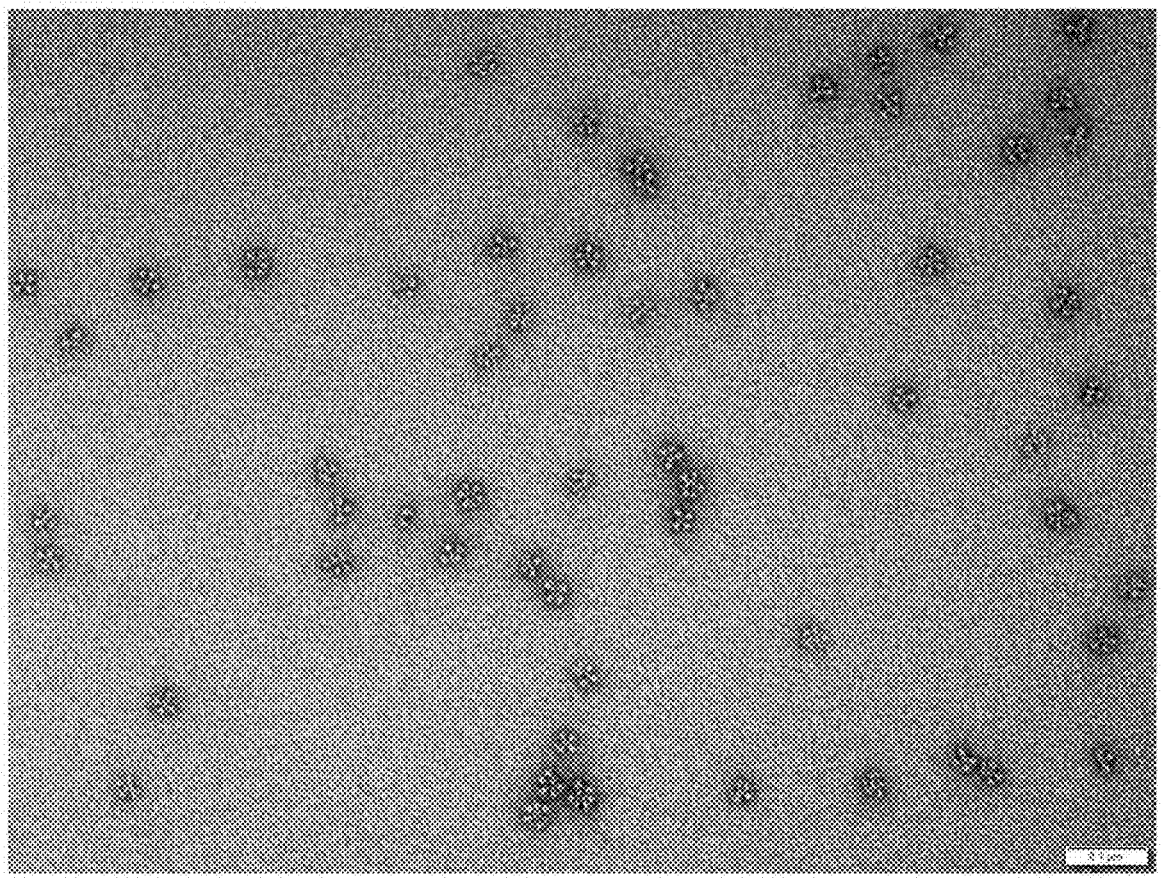
Figure 19D:
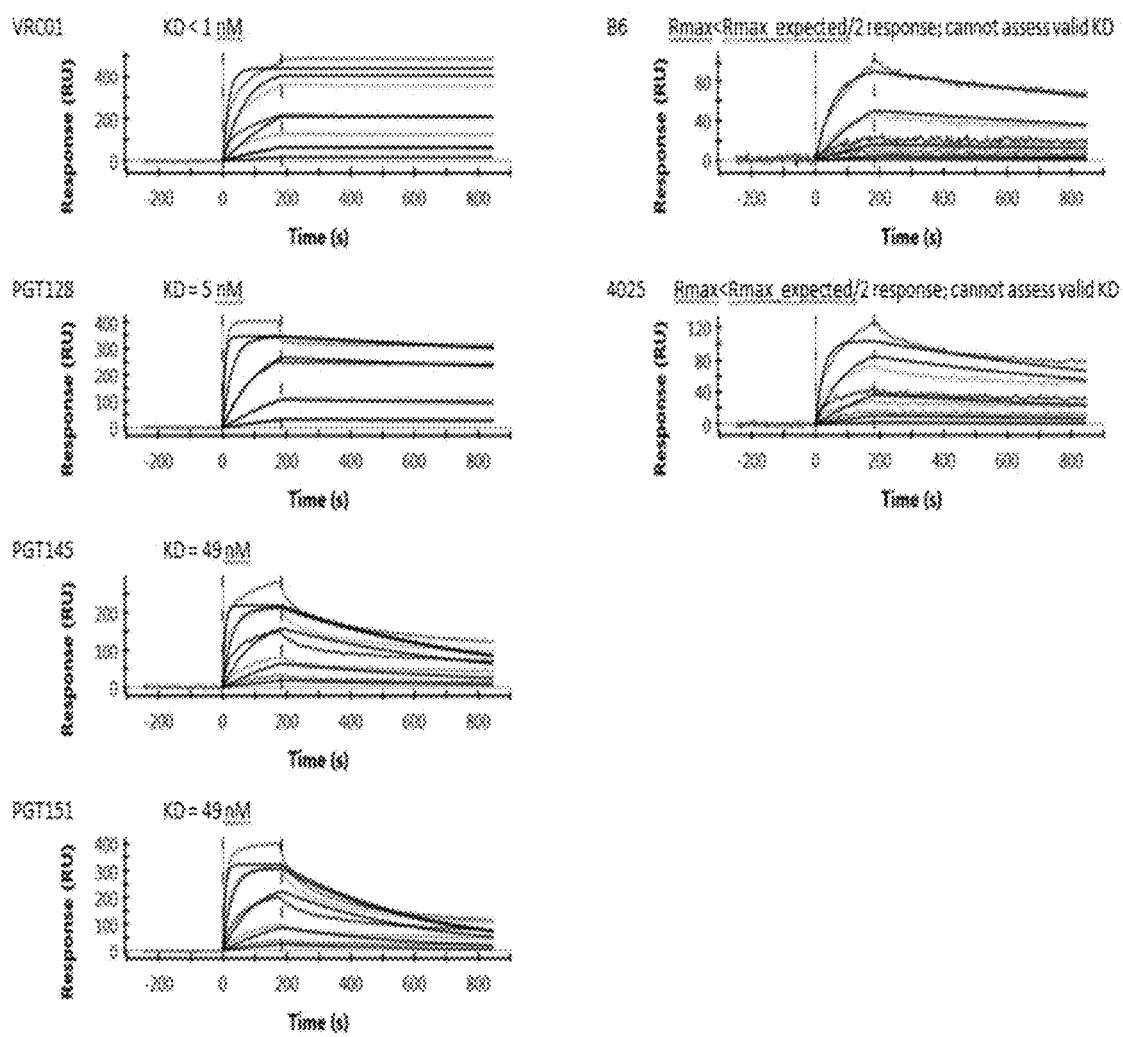

FIGS. 19A-19D depicts properties of the nanoparticle BG505 MD39 2JD6, an 8-mer of MD39 trimers based on the ferritin from *Pyrococcus Furiousis*. FIG. 19A. SECMALS trace illustrating that the purified particle in solution has the molecular weight expected of a particle composed of eight MD39 trimers each genetically fused via linkers to the 24-mer ferritin. FIG. 19B. Negative stain electron microscopy (EM) of BG505 MD39 2JD6, illustrating the existence of ordered particles. FIG. 19C. Negative stain electron microscopy (EM) of BG505 MD39 2JD6, illustrating the existence of ordered particles, at lower magnification and depicting a different sample field than in B. FIG. 19D. Antigenic profile of BG505 MD39 2JD6, assessed by SPR. BG505 MD39 2JD6 particles were captured on the sensor surface and Fabs of different antibodies were used as analytes to assess monovalent binding interactions. The SPR kinetic traces and the measured dissociation constants (KDs) for four bnAbs are shown on the left. SPR kinetics for two non-nAbs are shown at right, and in those cases the binding signal was significantly weaker than for the bnAbs (note the different scale on the y-axis).

Figure 20A:
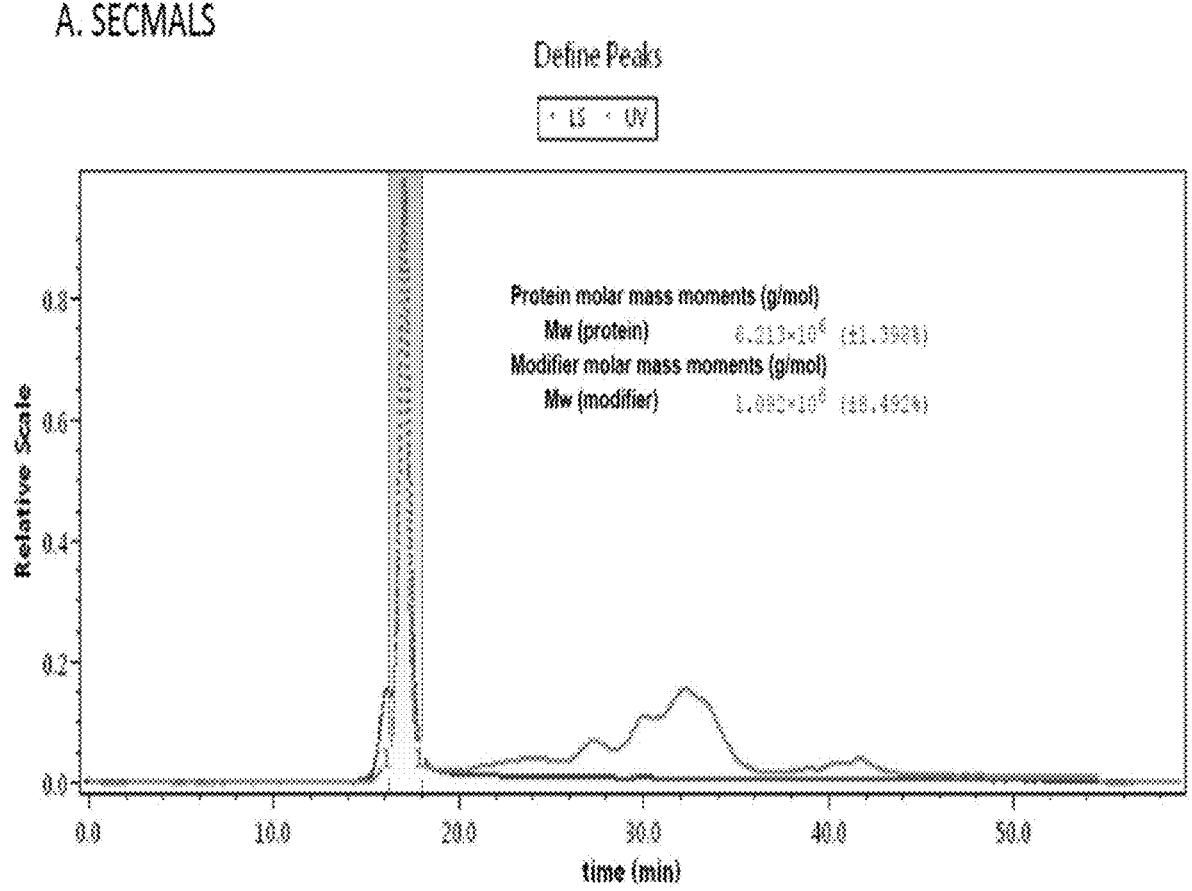
Figure 20B:
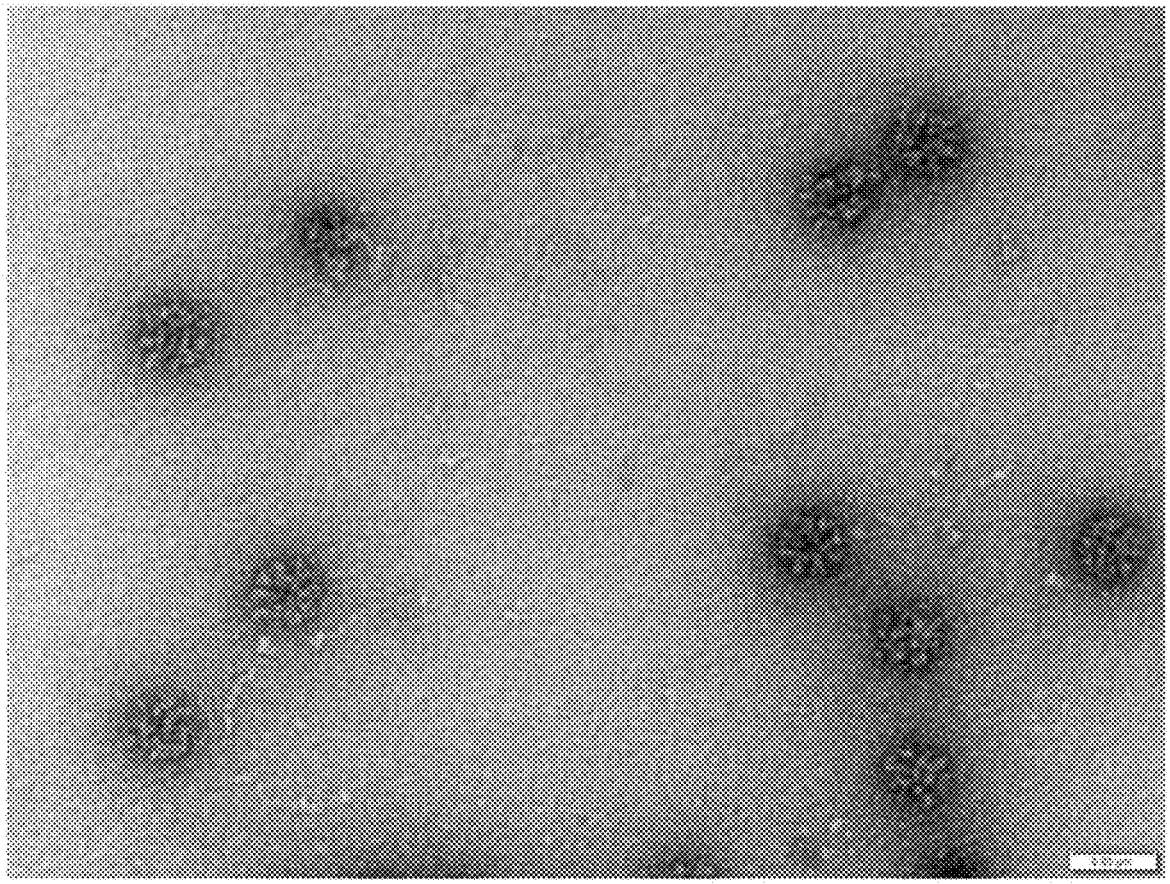
Figure 20C:
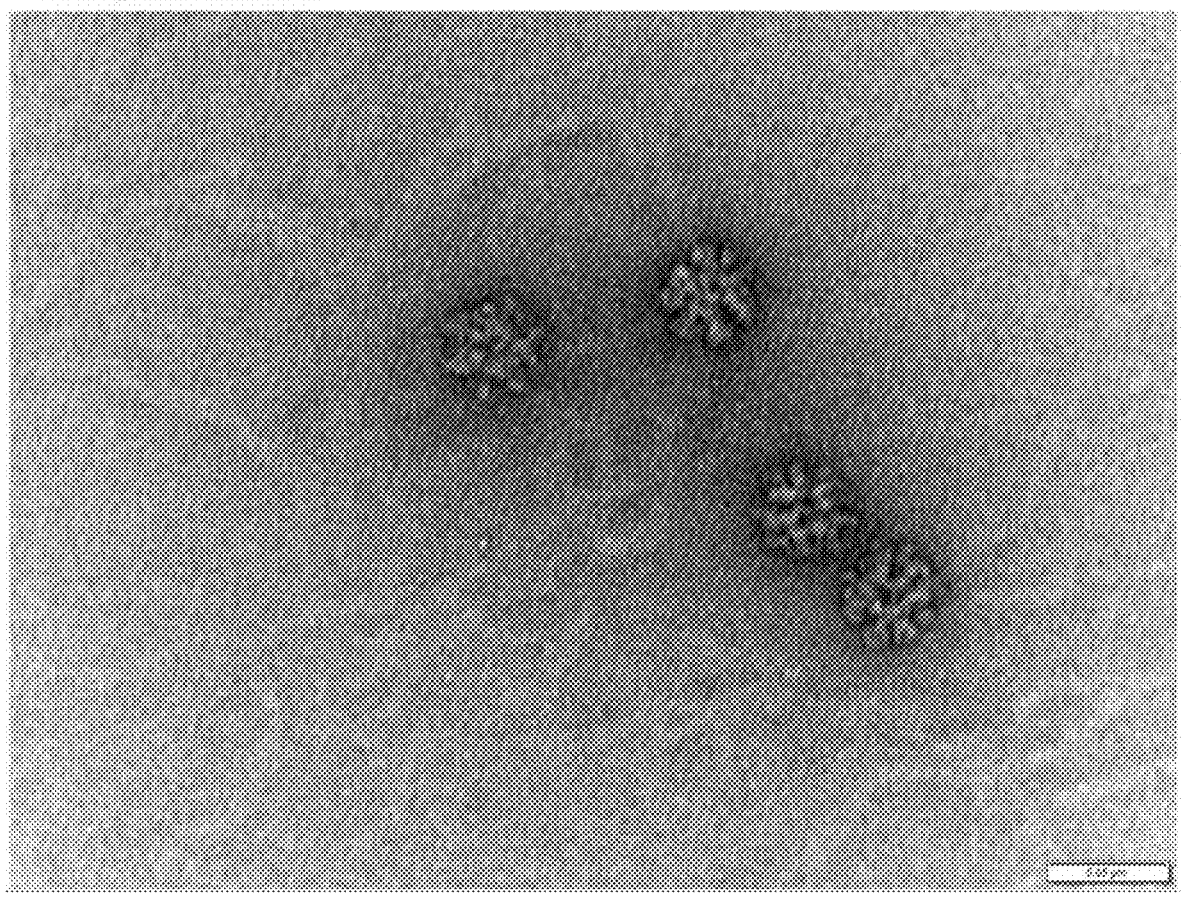
Figure 20D:
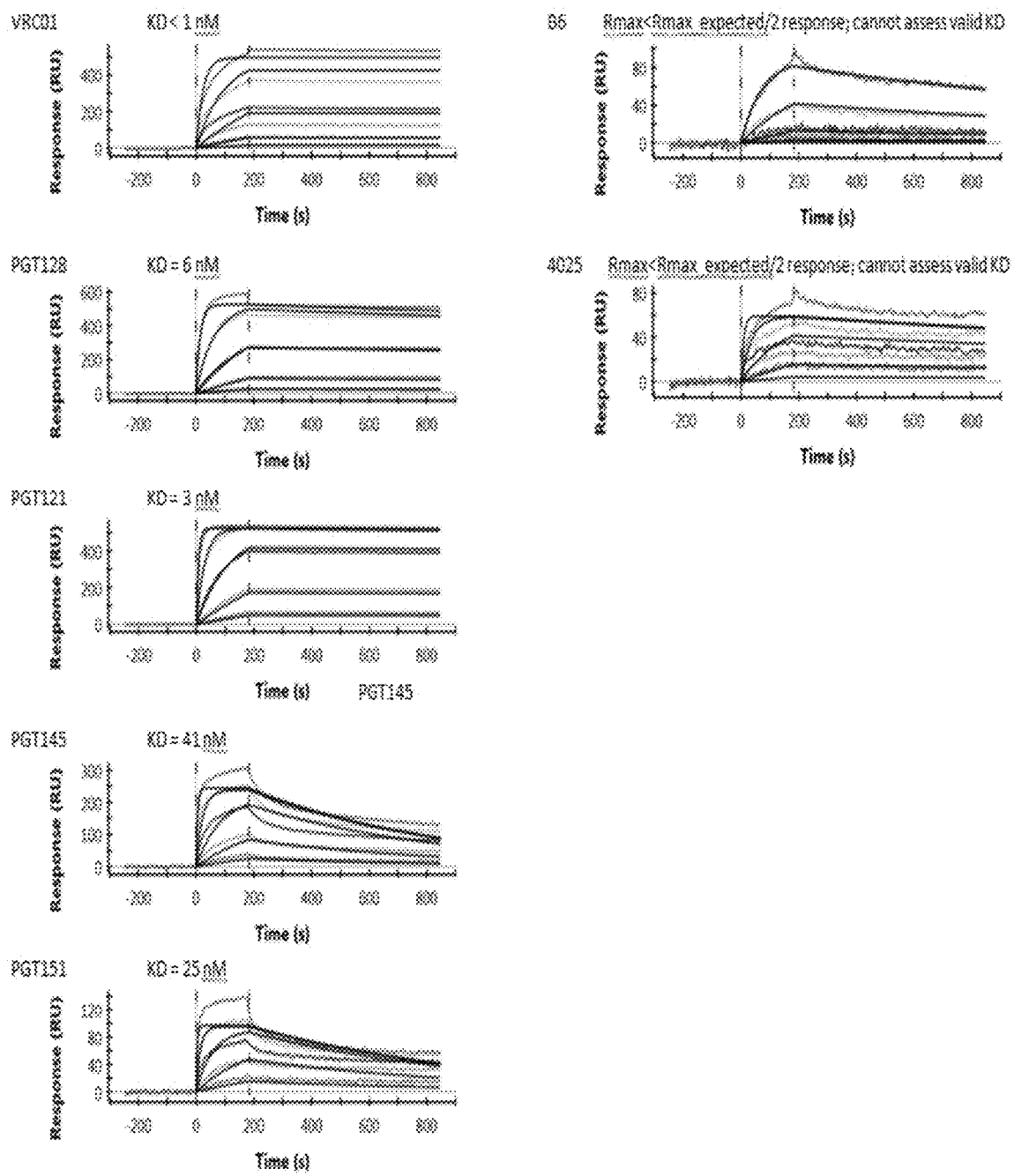

FIGS. 20A-20D depicts properties of the nanoparticle BG505 MD39 E2p, a 20-mer of MD39 trimers based on the Dihydrolipoyl Transacetylase (E2p) from *Bacillus Stearothermophilus*. FIG. 20A. SECMALS trace illustrating that the purified particle in solution has the molecular weight expected of a particle composed of 20 MD39 trimers each genetically fused via linkers to the underlying E2p 60-mer. FIG. 20B. Negative stain electron microscopy (EM) of BG505 MD39 E2p, illustrating the existence of ordered particles. FIG. 20C. Negative stain electron microscopy (EM) of BG505 MD39 E2p, illustrating the existence of ordered particles, at lower magnification and depicting a different sample field than in B. FIG. 20D. Antigenic profile of BG505 MD39 E2p, assessed by SPR. BG505 MD39 E2p particles were captured on the sensor surface and Fabs of different antibodies were used as analytes to assess monovalent binding interactions. The SPR kinetic traces and the measured dissociation constants (KDs) for five bnAbs are shown on the left. SPR kinetics for two non-nAbs are shown at right, and in those cases the binding signal was significantly weaker than for the bnAbs (note the different scale on the y-axis).

Figure 21A:
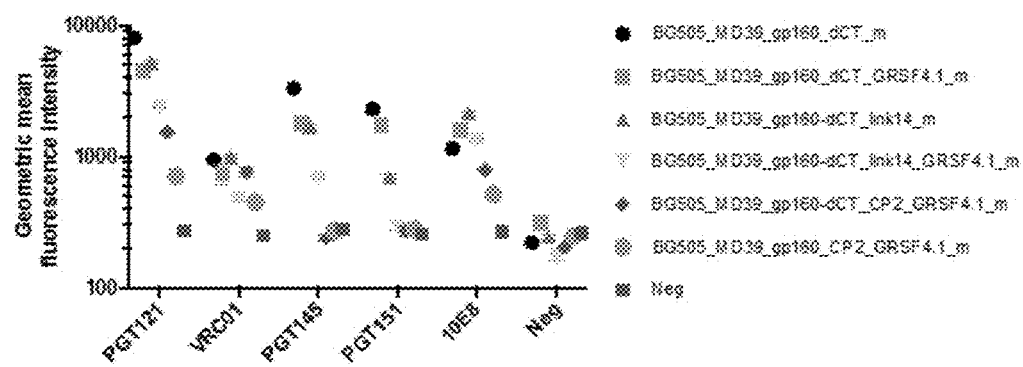
Figure 21B:
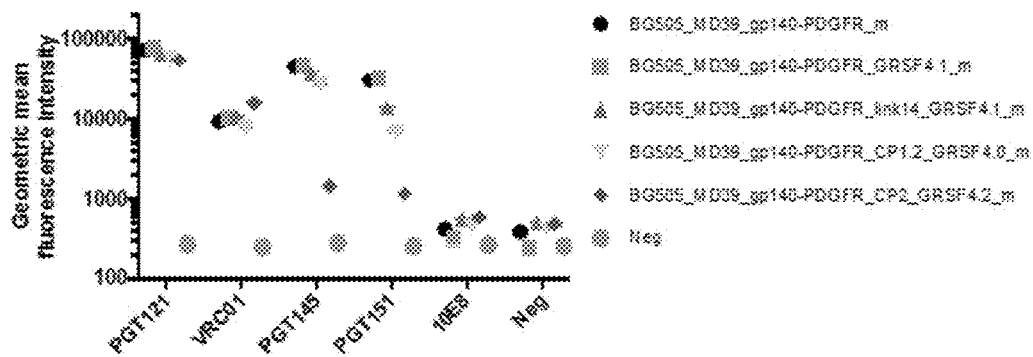

FIG. 21A-21B depict flow cytometry data demonstrating cell-surface expression and bnAb-binding of membrane-bound native-like trimers. FIG. 21A. Binding of bnAbs to membrane-bound stabilized trimers using native transmembrane domains. FIG. 21B. Binding of bnAbs to membrane-bound stabilized trimers anchored to the membrane by flexible linkers and PDGFR transmembrane domains.

Figures 22A, 22B, 22C, 22D, 22E, 22F:
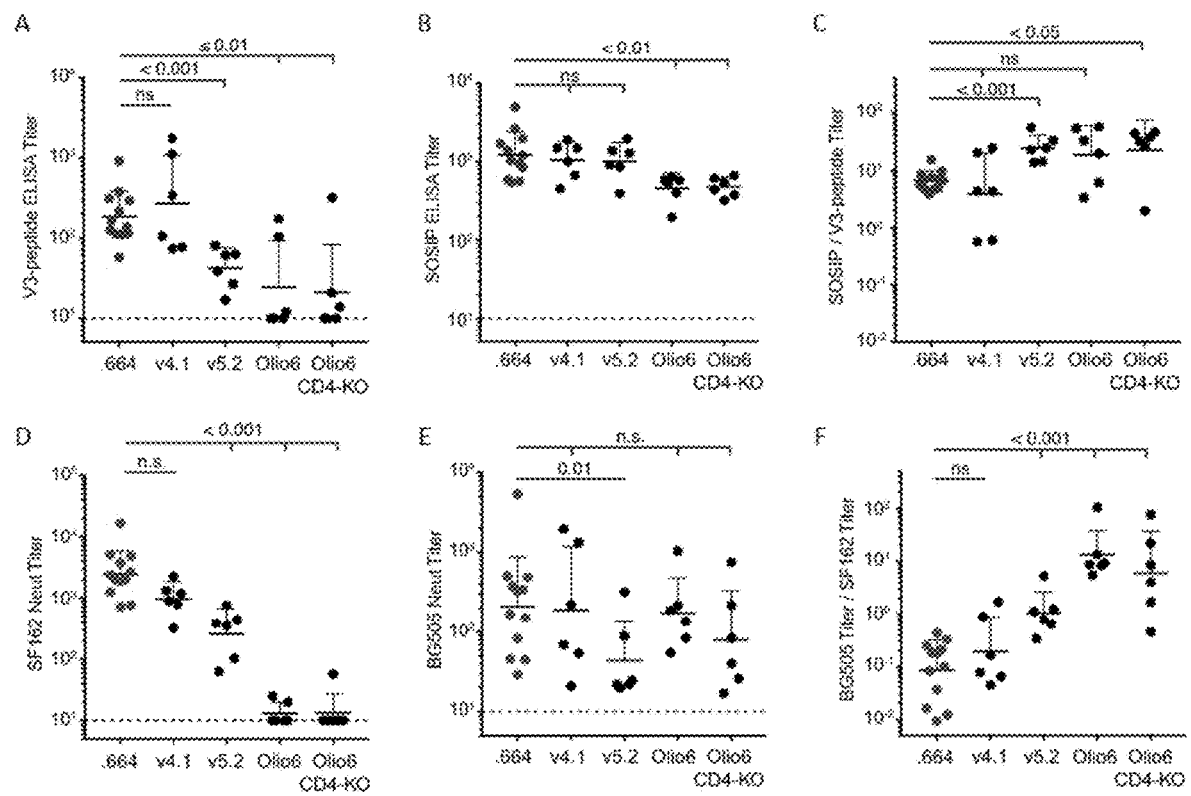

FIGS. 22A-22F depict results of NHP immunizations with BG505 Olio6 and BG505 Olio6 CD4-KO compared to BG505 SOSIP and two other comparator trimers (BG505 SOSIP v4.1 and BG505 SOSIP v5.2). The sequence and biophysical properties of BG505 SOSIP.v4.1 were reported in De Taeye et al. Cell 2015. The sequence and biophysical properties of BG505 SOSIP.v5.2 are not known. Rhesus macaques (6 animals per immunogen group) were immunized at 3 time points: week 0, week 8, and week 24. All immunizations were administered as split doses. Each immunization consisted of 2 subcutaneous injections of 50 µg of Env trimer protein+37.5 units (U) of Iscomatrix adjuvant (CSL) in sterile phosphate-buffered saline (PBS) diluent for a total of 100 µg of Env trimer protein+75 U of Iscomatrix per immunization per animal. Subcutaneous immunizations were given in a volume of 0.5 mL with a 1 inch, 25 gauge needle at the medial inner mid-thigh of each leg. Throughout the figure immunogen names are abbreviated as follows: BG505 SOSIP.664 (0.664 or BG505 WT), BG505 SOSIP.v4.1 (v4.1), BG505 SOSIP.v5.2 (v5.2), BG505 SOSIP Olio6 (Olio6), and BG505 SOSIP Olio6 CD4-KO (Olio6 CD4-KO). All nAb titer and ELISA binding Ab data panels show geometric mean titers with geometric SD. ns, non-significant. Also see FIG. 23. FIG. 22A. BG505 V3 loop peptide binding IgG titers in BG505 SOSIP.664, BG505 SOSIP.v4.1, BG505 SOSIP.v5.2, BG505 Olio6, and BG505 Olio6 CD4-KO immunized RMs two weeks after the $3^{rd}$ immunization. Olio6 and Olio6 CD4-KO both elicited significantly lower V3 binding antibody responses than BG505 SOSIP, indicating that the Olio6 and Olio6 CD4-KO retained native structure in vivo to a greater than BG505 SOSIP. Horizontal dotted line indicates limit of detection. N=6 or 12. FIG. 22B. BG505 SOSIP binding IgG titers in BG505 SOSIP.664, BG505 SOSIP.v4.1, BG505 SOSIP.v5.2, BG505 Olio6, and BG505 Olio6 CD4-KO immunized RMs two weeks after the 3' immunization. Olio6 and Olio6 CD4-KO both elicited significantly lower BG505 SOSIP-binding antibody responses than BG505 SOSIP. Horizontal dotted line indicates limit of detection. Week 26, N=6 or 12. FIG. 22C. Ratio of BG505 SOSIP to BG505 V3-peptide titers (as shown panels B and C) in immunized RMs two weeks after the $3^{rd}$ immunization. Olio6 and Olio6 CD4-KO both elicited responses with a significantly higher ratio than BG505 SOSIP, reflecting the strong suppression of V3 responses by Olio6 and Olio6 CD4-KO. Week 26, N=6 or 12. FIG. 22D. Tier 1 SF162 nAb titers in BG505 SOSIP.664, BG505 SOSIP.v4.1, BG505 SOSIP.v5.2, BG505 Olio6, and BG505 Olio6 CD4-KO immunized animals two weeks after the $3^{rd}$ immunization. Olio6 and Olio6 CD4-KO both elicited significantly lower SF162 tier 1 neutralization responses than BG505 SOSIP, also indicating that Olio6 and Olio6 CD4-KO retained native structure in vivo to a greater than BG505 SOSIP. Week 26, N=6 or 12. FIG. 22E. BG505 nAb titers in BG505 SOSIP.664, BG505 SOSIP.v4.1, BG505 SOSIP.v5.2, BG505 Olio6, and BG505 Olio6 CD4-KO immunized animals two weeks after the $3^{rd}$ immunization. Week 26, N=6 or 12. FIG. 22F. Ratio of BG505 and SF162 nAb titers (as shown in panels E and F) in immunized RMs two weeks after the $3^{rd}$ immunization. Olio6 and Olio6 CD4-KO both elicited responses with a significantly higher ratio than BG505 SOSIP, further indicating that Olio6 and Olio6 CD4-KO retained native structure in vivo to a greater than BG505 SOSIP. Week 26, N=6 or 12.

Figures 23A, 23B, 23C, 23D:
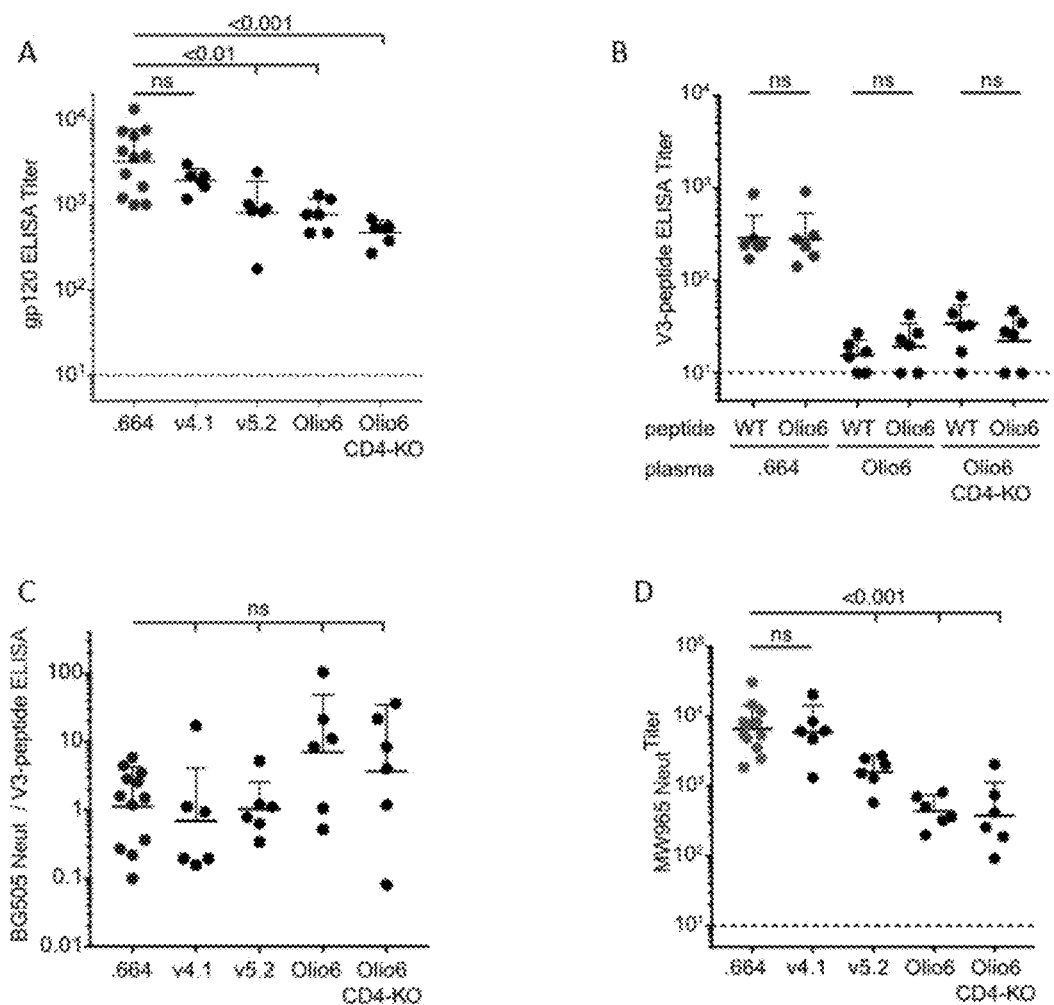

FIGS. 23A-23D depict additional results of NHP immunizations with BG505 Olio6 and BG505 Olio6 CD4-KO compared to BG505 SOSIP and two other comparator trimers (BG505 SOSIP v4.1 and BG505 SOSIP v5.2). The data in this figure pertain to the same RM immunization experiment described in FIG. 22. Throughout the figure immunogen names are abbreviated as follows: BG505 SOSIP.664 (0.664), BG505 SOSIP.v4.1 (v4.1), BG505 SOSIP.v5.2 (v5.2), BG505 SOSIP Olio6 (Olio6), and BG505 SOSIP Olio6 CD4-KO (Olio6 CD4-KO). ns, non-significant. All nAb titer and ELISA binding Ab data panels show geometric mean titers with geometric SD. FIG. 23A. BG505 gp120 binding IgG titer 2 weeks after the $3^{rd}$ immunization. Olio6 and Olio6 CD4-KO both elicited significantly lower gp120 antibody binding responses than BG505 SOSIP, further indicating that Olio6 and Olio6 CD4-KO retained native structure in vivo to a greater than BG505 SOSIP. Week 26, N=6 or 12. FIG. 23B. Comparison of V3-peptide ELISA titers against the BG505 Olio6 V3 loop peptide (Olio6) and the BG505 SOSIP.664 V3 loop peptide (WT). V3 loop peptide binding IgG titers for both of these peptides were measured from plasma of RMs immunized with BG505 SOSIP.664, BG505 Olio6, or BG505 Olio6 CD4-KO, two weeks after the 3$^{rd}$ immunization. Olio6 and Olio6 CD4-KO both elicited significantly lower V3 binding antibody responses than BG505 SOSIP, regardless of whether the ELISA measurement is performed with WT or Olio6 V3 peptides. Week 26, N=6. FIG. 23C. The ratio of BG505 nAb titer to V3-peptide binding IgG titer after the 3$^{rd}$ immunization. Week 26, N=6 or 12. FIG. 23D. Tier 1 MW965 nAb titers after the 3$^{rd}$ immunization. Week 26, N=6 or 12.

Figure 24A:
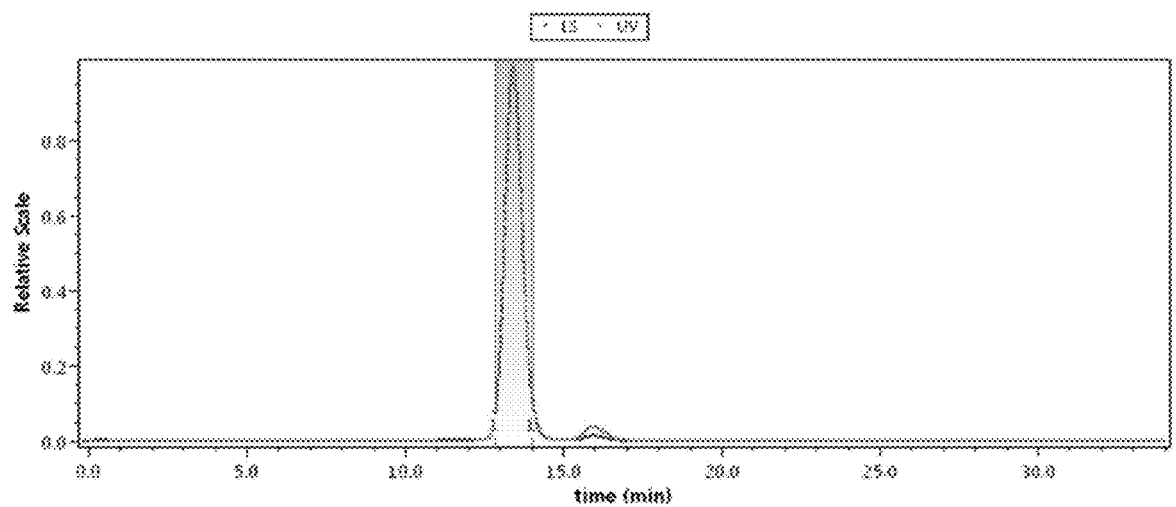
Figure 24B:
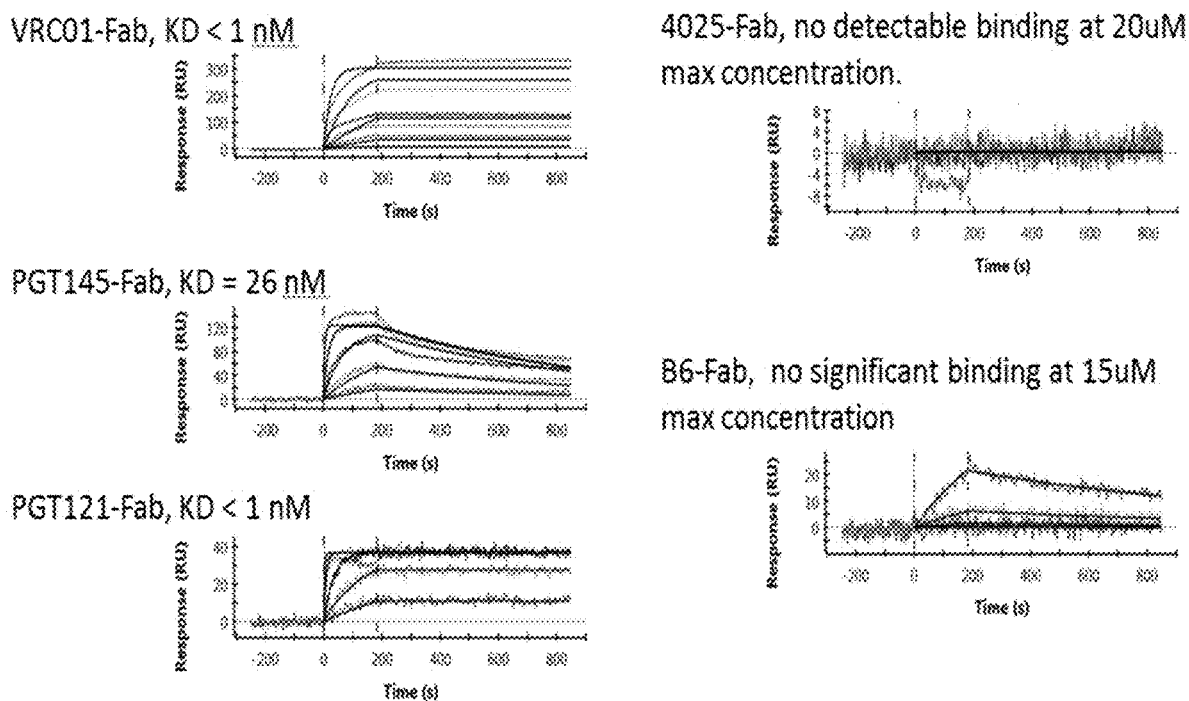

FIGS. 24A-24B depict properties of BG505_MD39_CP1.2_GRSF7_qLoops1. FIG. 24A. SEC-MALS analysis showing that the molecule is a trimer in solution. FIG. 24B. SPR analysis showing that the trimer exhibits a native-like antigenic profile. In particular the trimer binds well to the trimer-structure-specific bnAb PGT145, as well as two other bnAbs VRC01 and PGT121, but does not exhibit significant affinity for non-neutralizing Abs B6 or 4025.

DETAILED DESCRIPTION OF THE INVENTION

The invention pertains to the identification, design, synthesis and isolation of mutant trimers disclosed herein as well as nucleic acids encoding the same. The present invention also relates to homologues, derivatives and variants of the sequences of the mutant trimers and nucleic acids encoding the same, wherein it is preferred that the homologue, derivative or variant have at least 50%, at least 60%, at least 70%, at least 75%, at least 80%, at least 85%, at least 90%, at least 93%, at least 95%, at least 97%, at least 98% or at least 99% homology or identity with the sequence of the mutant trimers and nucleic acids encoding the same. It is noted that within this specification, homology to sequences of the mutant proteins and nucleic acids encoding the same refers to the homology of the homologue, derivative or variant to the binding site of the mutant proteins and nucleic acids encoding the same.

The invention still further relates to nucleic acid sequences expressing the mutant trimers disclosed herein, or homologues, variants or derivatives thereof. One of skill in the art will know, recognize and understand techniques used to create such. Additionally, one of skill in the art will be able to incorporate such a nucleic acid sequence into an appropriate vector, allowing for production of the amino acid sequence of mutant proteins and nucleic acids encoding the same or a homologue, variant or derivative thereof.

Where used herein and unless specifically indicated otherwise, the following terms are intended to have the following meanings in addition to any broader (or narrower) meanings the terms might enjoy in the art:

The term "isolated" or "non-naturally occurring" is used herein to indicate that the isolated moiety (e.g. peptide or compound) exists in a physical milieu distinct from that in which it occurs in nature. For example, the isolated peptide may be substantially isolated with respect to the complex cellular milieu in which it naturally occurs. The absolute level of purity is not critical, and those skilled in the art may readily determine appropriate levels of purity according to the use to which the peptide is to be put. The term "isolating" when used a step in a process is to be interpreted accordingly.

In many circumstances, the isolated moiety will form part of a composition (for example a more or less crude extract containing many other molecules and substances), buffer system, matrix or excipient, which may for example contain other components (including proteins, such as albumin).

In other circumstances, the isolated moiety may be purified to essential homogeneity, for example as determined by PAGE or column chromatography (for example HPLC or mass spectrometry). In preferred embodiments, the isolated peptide or nucleic acid of the invention is essentially the sole peptide or nucleic acid in a given composition.

In an advantageous embodiment, a tag may be utilized for purification or biotinylation. The tag for purification may be a his tag. In another embodiment, the tag for biotinylation may be an avi-tag. Other tags are contemplated for purification, however, purification may be accomplished without a tag. In another embodiment, antibody (such as, not limited to, a broadly neutralizing antibody) affinity columns are contemplated. In another embodiment, lectin columns are contemplated.

Native-like soluble trimerscan be made by several methods that all involve stabilizing associations between envelope protein subunits. See, e.g., P. Dosenovic et al., "Immunization for HIV-1 broadly neutralizing antibodies in human Ig knockin mice," Cell, 161:1-11, 2015; J. G. Jardine et al., "Priming a broadly neutralizing antibody response to HIV-1 using a germline targeting immunogen," Science, doi: 10.1126/science.aac5894, 2015 and R. W. Sanders et al., "HIV-1 neutralalizing antibodies induced by native-like envelope trimers," Science, doi: 10.1126/science.aac4223, 2015.

The proteins and compounds of the invention need not be isolated in the sense defined above, however.

The term "pharmaceutical composition" is used herein to define a solid or liquid composition in a form, concentration and level of purity suitable for administration to a patient (e.g. a human patient) upon which administration it may elicit the desired physiological changes. The terms "immunogenic composition" and "immunological composition" and "immunogenic or immunological composition" cover any composition that elicits an immune response against the targeted pathogen, HIV. Terms such as "vaccinal composition" and "vaccine" and "vaccine composition" cover any composition that induces a protective immune response against the targeted pathogen or which efficaciously protects against the pathogen; for instance, after administration or injection, elicits a protective immune response against the targeted pathogen or provides efficacious protection against the pathogen. Accordingly, an immunogenic or immunological composition induces an immune response, which may, but need not, be a protective immune response. An immunogenic or immunological composition may be used in the treatment of individuals infected with the pathogen, e.g., to stimulate an immune response against the pathogen, such as by stimulating antibodies against the pathogen. Thus, an immunogenic or immunological composition may be a pharmaceutical composition. Furthermore, when the text speaks of "immunogen, antigen or epitope", an immunogen may be an antigen or an epitope of an antigen. A diagnostic composition is a composition containing a compound or antibody, e.g., a labeled compound or antibody, that is used for detecting the presence in a sample, such as a biological sample, e.g., blood, semen, vaginal fluid, etc, of an antibody that binds to the compound or an immunogen, antigen or epitope that binds to the antibody; for instance, an anti-HIV antibody or an HIV immunogen, antigen or epitope.

A "conservative amino acid change" is one in which the amino acid residue is replaced with an amino acid residue having a similar side chain. Families of amino acid residues having similar side chains have been defined in the art. These families include amino acids with basic side chains (e.g. lysine, arginine and histidine), acidic side chains (e.g. aspartic acid and glutamic acid), non-charged amino acids or polar side chains (e.g. glycine, asparagine, glutamine, serine, threonine, tyrosine and cysteine), non-polar side chains (e.g. alanine, valine, leucine, isoleucine, proline, phenylalanine, methionine and tryptophan), beta-branched side chains (e.g. threonine, valine and isoleucine), and aromatic side chains (e.g. tyrosine, phenylalanine, tryptophan and histidine).

The terms "protein", "peptide", "polypeptide", and "amino acid sequence" are used interchangeably herein to refer to polymers of amino acid residues of any length. The polymer may be linear or branched, it may comprise modified amino acids or amino acid analogs, and it may be interrupted by chemical moieties other than amino acids. The terms also encompass an amino acid polymer that has been modified naturally or by intervention; for example disulfide bond formation, glycosylation, lipidation, acetylation, phosphorylation, or any other manipulation or modification, such as conjugation with a labeling or bioactive component.

As used herein, the terms "antigen" or "immunogen" are used interchangeably to refer to a substance, typically a protein, which is capable of inducing an immune response in a subject. The term also refers to proteins that are immunologically active in the sense that once administered to a subject (either directly or by administering to the subject a nucleotide sequence or vector that encodes the protein) is able to evoke an immune response of the humoral and/or cellular type directed against that protein.

The term "antibody" includes intact molecules as well as fragments thereof, such as Fab, F(ab')$_2$, Fv and scFv which are capable of binding the epitope determinant. These antibody fragments retain some ability to selectively bind with its antigen or receptor and include, for example:

(a) Fab, the fragment which contains a monovalent antigen-binding fragment of an antibody molecule may be produced by digestion of whole antibody with the enzyme papain to yield an intact light chain and a portion of one heavy chain;

(b) Fab', the fragment of an antibody molecule may be obtained by treating whole antibody with pepsin, followed by reduction, to yield an intact light chain and a portion of the heavy chain; two Fab' fragments are obtained per antibody molecule;

(c) F(ab')$_2$, the fragment of the antibody that may be obtained by treating whole antibody with the enzyme pepsin without subsequent reduction; F(ab')$_2$ is a dimer of two Fab' fragments held together by two disulfide bonds;

(d) scFv, including a genetically engineered fragment containing the variable region of a heavy and a light chain as a fused single chain molecule.

General methods of making these fragments are known in the art. (See for example, Harlow and Lane, Antibodies: A Laboratory Manual, Cold Spring Harbor Laboratory, New York (1988), which is incorporated herein by reference). Fabs, Fv and scFV may also be made recombinantly, i.e. expressed as Fab, Fv or scFV rather than cleaving an intact IgG.

A "neutralizing antibody" may inhibit the entry of HIV-1 virus for example SF162 and/or JR-CSF with a neutralization index >1.5 or >2.0. Broad and potent neutralizing antibodies may neutralize greater than about 50% of HIV-1 viruses (from diverse clades and different strains within a clade) in a neutralization assay. The inhibitory concentration of the monoclonal antibody may be less than about 25 mg/ml to neutralize about 50% of the input virus in the neutralization assay.

An "isolated antibody" or "non-naturally occurring antibody" is one that has been separated and/or recovered from a component of its natural environment. Contaminant components of its natural environment are materials that would interfere with diagnostic or therapeutic uses for the antibody, and may include enzymes, hormones, and other proteinaceous or nonproteinaceous solutes. In preferred embodiments, the antibody is purified: (1) to greater than 95% by weight of antibody as determined by the Lowry method, and most preferably more than 99% by weight; (2) to a degree sufficient to obtain at least 15 residues of N-terminal or internal amino acid sequence by use of a spinning cup sequenator; or (3) to homogeneity by SDS-PAGE under reducing or non-reducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

The term "monoclonal antibody" as used herein refers to an antibody obtained from a population of substantially homogeneous antibodies, i.e., the individual antibodies which may comprise the population are identical except for possible naturally occurring mutations that may be present in minor amounts. Monoclonal antibodies are highly specific, being directed against a single antigenic site. Furthermore, in contrast to polyclonal antibody preparations that include different antibodies directed against different determinants (epitopes), each monoclonal antibody is directed against a single determinant on the antigen. In addition to their specificity, the monoclonal antibodies are advantageous in that they may be synthesized uncontaminated by other antibodies. The modifier "monoclonal" is not to be construed as requiring production of the antibody by any particular method. For example, the monoclonal antibodies useful in the present invention may be prepared by the hybridoma methodology first described by Kohler et al., Nature, 256:495 (1975), or may be made using recombinant DNA methods in bacterial, eukaryotic animal or plant cells (see, e.g., U.S. Pat. No. 4,816,567). The "monoclonal antibodies" may also be isolated from phage antibody libraries using the techniques described in Clackson et al., Nature, 352:624-628 (1991) and Marks et al., J. Mol. Biol., 222: 581-597 (1991), for example.

An "antibody fragment" may comprise a portion of an intact antibody, preferably the antigen binding or variable region of the intact antibody. Examples of antibody fragments include Fab, Fab', F(ab')$_2$, scFV and Fv fragments; diabodies; linear antibodies (see U.S. Pat. No. 5,641,870; Zapata et al., Protein Eng. 8(10): 1057-1062 [1995]); single-chain antibody molecules; and multispecific antibodies formed from antibody fragments.

It should be understood that the proteins, including the antibodies of the invention may differ from the exact sequences illustrated and described herein. Thus, the invention contemplates deletions, additions and substitutions to the sequences shown, so long as the sequences function in accordance with the methods of the invention. In this regard, particularly preferred substitutions will generally be conservative in nature, i.e., those substitutions that take place within a family of amino acids. For example, amino acids are generally divided into four families: (1) acidic—aspartate and glutamate; (2) basic—lysine, arginine, histidine; (3) non-polar—alanine, valine, leucine, isoleucine, proline, phenylalanine, methionine, tryptophan; and (4) uncharged polar—glycine, asparagine, glutamine, cysteine, serine threonine, tyrosine. Phenylalanine, tryptophan, and tyrosine are sometimes classified as aromatic amino acids. It is reasonably predictable that an isolated or non-naturally occurring replacement of leucine with isoleucine or valine, or vice versa; an aspartate with a glutamate or vice versa; a threonine with a serine or vice versa; or a similar conservative replacement of an amino acid with a structurally related amino acid, will not have a major effect on the biological activity. Proteins having substantially the same amino acid sequence as the sequences illustrated and described but possessing minor amino acid substitutions that do not substantially affect the immunogenicity of the protein are, therefore, within the scope of the invention.

As used herein the terms "nucleotide sequences" and "nucleic acid sequences" refer to deoxyribonucleic acid (DNA) or ribonucleic acid (RNA) sequences, including, without limitation, messenger RNA (mRNA), DNA/RNA hybrids, or synthetic nucleic acids. The nucleic acid may be single-stranded, or partially or completely double-stranded (duplex). Duplex nucleic acids may be homoduplex or heteroduplex.

As used herein the term "transgene" may used to refer to "recombinant" nucleotide sequences that may be derived from any of the nucleotide sequences encoding the proteins of the present invention. The term "recombinant" means a nucleotide sequence that has been manipulated "by man" and which does not occur in nature, or is linked to another nucleotide sequence or found in a different arrangement in nature. It is understood that manipulated "by man" means manipulated by some artificial means, including by use of machines, codon optimization, restriction enzymes, etc.

For example, in one embodiment the nucleotide sequences may be mutated such that the activity of the encoded proteins in vivo is abrogated. In another embodiment the nucleotide sequences may be codon optimized, for example the codons may be optimized for human use. In preferred embodiments the nucleotide sequences of the invention are both mutated to abrogate the normal in vivo function of the encoded proteins, and codon optimized for human use. For example, each of the sequences of the invention, such as the mutant trimers, may be altered in these ways.

As regards codon optimization, the nucleic acid molecules of the invention have a nucleotide sequence that encodes the antigens of the invention and may be designed to employ codons that are used in the genes of the subject in which the antigen is to be produced. Many viruses, including HIV and other lentiviruses, use a large number of rare codons and, by altering these codons to correspond to codons commonly used in the desired subject, enhanced expression of the antigens may be achieved. In a preferred embodiment, the codons used are "humanized" codons, i.e., the codons are those that appear frequently in highly expressed human genes (Andre et al., J. Virol. 72:1497-1503, 1998) instead of those codons that are frequently used by HIV. Such codon usage provides for efficient expression of the transgenic HIV proteins in human cells. Any suitable method of codon optimization may be used. Such methods, and the selection of such methods, are well known to those of skill in the art. In addition, there are several companies that will optimize codons of sequences, such as Geneart (geneart.com). Thus, the nucleotide sequences of the invention may readily be codon optimized.

The invention further encompasses nucleotide sequences encoding functionally and/or antigenically equivalent variants and derivatives of the antigens of the invention and functionally equivalent fragments thereof. These functionally equivalent variants, derivatives, and fragments display the ability to retain antigenic activity. For instance, changes in a DNA sequence that do not change the encoded amino acid sequence, as well as those that result in conservative substitutions of amino acid residues, one or a few amino acid deletions or additions, and substitution of amino acid residues by amino acid analogs are those which will not significantly affect properties of the encoded polypeptide. Conservative amino acid substitutions are glycine/alanine; valine/isoleucine/leucine; asparagine/glutamine; aspartic acid/glutamic acid; serine/threonine/methionine; lysine/arginine; and phenylalanine/tyrosine/tryptophan. In one embodiment, the variants have at least 50%, at least 55%, at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98% or at least 99% homology or identity to the antigen, epitope, immunogen, peptide or polypeptide of interest.

For the purposes of the present invention, sequence identity or homology is determined by comparing the sequences when aligned so as to maximize overlap and identity while minimizing sequence gaps. In particular, sequence identity may be determined using any of a number of mathematical algorithms. A nonlimiting example of a mathematical algorithm used for comparison of two sequences is the algorithm of Karlin & Altschul, Proc. Natl. Acad. Sci. USA 1990; 87: 2264-2268, modified as in Karlin & Altschul, Proc. Natl. Acad. Sci. USA 1993; 90: 5873-5877.

Another example of a mathematical algorithm used for comparison of sequences is the algorithm of Myers & Miller, CABIOS 1988; 4: 11-17. Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 may be used. Yet another useful algorithm for identifying regions of local sequence similarity and alignment is the FASTA algorithm as described in Pearson & Lipman, Proc. Natl. Acad. Sci. USA 1988; 85: 2444-2448.

Advantageous for use according to the present invention is the WU-BLAST (Washington University BLAST) version 2.0 software. WU-BLAST version 2.0 executable programs for several UNIX platforms may be downloaded from ftp://blast.wustl.edu/blast/executables. This program is based on WU-BLAST version 1.4, which in turn is based on the public domain NCBI-BLAST version 1.4 (Altschul & Gish, 1996, Local alignment statistics, Doolittle ed., Methods in Enzymology 266: 460-480; Altschul et al., Journal of Molecular Biology 1990; 215: 403-410; Gish & States, 1993; Nature Genetics 3: 266-272; Karlin & Altschul, 1993; Proc. Natl. Acad. Sci. USA 90: 5873-5877; all of which are incorporated by reference herein).

The various recombinant nucleotide sequences and antibodies of the invention are made using standard recombinant DNA and cloning techniques. Such techniques are well known to those of skill in the art. See for example, "Molecular Cloning: A Laboratory Manual", second edition (Sambrook et al. 1989).

The nucleotide sequences of the present invention may be inserted into "vectors." The term "vector" is widely used and understood by those of skill in the art, and as used herein the term "vector" is used consistent with its meaning to those of skill in the art. For example, the term "vector" is commonly used by those skilled in the art to refer to a vehicle that allows or facilitates the transfer of nucleic acid molecules from one environment to another or that allows or facilitates the manipulation of a nucleic acid molecule.

Any vector that allows expression of the antibodies of the present invention may be used in accordance with the present invention. In certain embodiments, the antibodies of the present invention may be used in vitro (such as using cell-free expression systems) and/or in cultured cells grown in vitro in order to produce the encoded HIV− antibodies, which may then be used for various applications such as in the production of proteinaceous vaccines. For such applications, any vector that allows expression of the antibodies in vitro and/or in cultured cells may be used.

For applications where it is desired that the antibodies be expressed in vivo, for example when the transgenes of the invention are used in DNA or DNA-containing vaccines, any vector that allows for the expression of the antibodies of the present invention and is safe for use in vivo may be used. In preferred embodiments the vectors used are safe for use in humans, mammals and/or laboratory animals.

For the antibodies of the present invention to be expressed, the protein coding sequence should be "operably linked" to regulatory or nucleic acid control sequences that direct transcription and translation of the protein. As used herein, a coding sequence and a nucleic acid control sequence or promoter are said to be "operably linked" when they are covalently linked in such a way as to place the expression or transcription and/or translation of the coding sequence under the influence or control of the nucleic acid control sequence. The "nucleic acid control sequence" may be any nucleic acid element, such as, but not limited to promoters, enhancers, IRES, introns, and other elements described herein that direct the expression of a nucleic acid sequence or coding sequence that is operably linked thereto. The term "promoter" will be used herein to refer to a group of transcriptional control modules that are clustered around the initiation site for RNA polymerase II and that when operationally linked to the protein coding sequences of the invention lead to the expression of the encoded protein. The expression of the transgenes of the present invention may be under the control of a constitutive promoter or of an inducible promoter, which initiates transcription only when exposed to some particular external stimulus, such as, without limitation, antibiotics such as tetracycline, hormones such as ecdysone, or heavy metals. The promoter may also be specific to a particular cell-type, tissue or organ. Many suitable promoters and enhancers are known in the art, and any such suitable promoter or enhancer may be used for expression of the transgenes of the invention. For example, suitable promoters and/or enhancers may be selected from the Eukaryotic Promoter Database (EPDB).

The vectors used in accordance with the present invention should typically be chosen such that they contain a suitable gene regulatory region, such as a promoter or enhancer, such that the antibodies of the invention may be expressed.

Any suitable vector may be used depending on the application. For example, plasmids, viral vectors, bacterial vectors, protozoal vectors, insect vectors, baculovirus expression vectors, yeast vectors, mammalian cell vectors, and the like, may be used. Suitable vectors may be selected by the skilled artisan taking into consideration the characteristics of the vector and the requirements for expressing the antibodies under the identified circumstances.

In an advantageous embodiment, IgG1 and Fab expression vectors may be utilized to reconstitute heavy and light chain constant regions if heavy and light chain genes of the antibodies of the present invention are cloned.

When the aim is to express the antibodies of the invention in vivo in a subject, for example in order to generate an immune response against an HIV-1 antigen and/or protective immunity against HIV-1, expression vectors that are suitable for expression on that subject, and that are safe for use in vivo, should be chosen. For example, in some embodiments it may be desired to express the antibodies of the invention in a laboratory animal, such as for pre-clinical testing of the HIV-1 immunogenic compositions and vaccines of the invention. In other embodiments, it will be desirable to express the antibodies of the invention in human subjects, such as in clinical trials and for actual clinical use of the immunogenic compositions and vaccine of the invention. Any vectors that are suitable for such uses may be employed, and it is well within the capabilities of the skilled artisan to select a suitable vector. In some embodiments it may be preferred that the vectors used for these in vivo applications are attenuated to vector from amplifying in the subject. For example, if plasmid vectors are used, preferably they will lack an origin of replication that functions in the subject so as to enhance safety for in vivo use in the subject. If viral vectors are used, preferably they are attenuated or replication-defective in the subject, again, so as to enhance safety for in vivo use in the subject.

In preferred embodiments of the present invention viral vectors are used. Viral expression vectors are well known to those skilled in the art and include, for example, viruses such as adenoviruses, adeno-associated viruses (AAV), alphaviruses, herpesviruses, retroviruses and poxviruses, including avipox viruses, attenuated poxviruses, vaccinia viruses, and particularly, the modified vaccinia Ankara virus (MVA; ATCC Accession No. VR-1566). Such viruses, when used as expression vectors are innately non-pathogenic in the selected subjects such as humans or have been modified to render them non-pathogenic in the selected subjects. For example, replication-defective adenoviruses and alphaviruses are well known and may be used as gene delivery vectors.

The nucleotide sequences and vectors of the invention may be delivered to cells, for example if the aim is to express the HIV-1 antigens in cells in order to produce and isolate the expressed proteins, such as from cells grown in culture. For expressing the antibodies in cells any suitable transfection, transformation, or gene delivery methods may be used. Such methods are well known by those skilled in the art, and one of skill in the art would readily be able to select a suitable method depending on the nature of the nucleotide sequences, vectors, and cell types used. For example, transfection, transformation, microinjection, infection, electroporation, lipofection, or liposome-mediated delivery could be used. Expression of the antibodies may be carried out in any suitable type of host cells, such as bacterial cells, yeast, insect cells, and mammalian cells. The antibodies of the invention may also be expressed using including in vitro transcription/translation systems. All of such methods are well known by those skilled in the art, and one of skill in the art would readily be able to select a suitable method depending on the nature of the nucleotide sequences, vectors, and cell types used.

A synthetic mutant trimer may be chemically synthesized in whole or part using techniques that are well-known in the art (see, e.g., Kochendoerfer, G. G., 2001). Additionally, homologs and derivatives of the polypeptide may be also be synthesized.

Alternatively, methods which are well known to those skilled in the art may be used to construct expression vectors containing nucleic acid molecules that encode the polypeptide or homologs or derivatives thereof under appropriate transcriptional/translational control signals, for expression. These methods include in vitro recombinant DNA techniques, synthetic techniques and in vivo recombination/genetic recombination. See, for example, the techniques described in Maniatis et al., 1989.

The HIV envelope protein (Env) is the target of broadly neutralizing antibodies (bnAbs) in natural infection. Env is a membrane protein composed of a trimer of gp120 and gp41 subunits that contains a high degree of sequence diversity and a surface that is shielded by N-linked glycans. The bnAbs that target Env often have unusual features such as a long complementarity-determining region (CDR) H3, high levels of somatic hypermutation (SHM), and insertions and deletions (INDELS). Furthermore, most of the bnAbs recognize complex epitopes that are typically non-linear and have both protein and glycan components.

The most common epitope of bnAbs in HIV infected individuals is a high mannose glycan patch at the base of the variable loop V3 that includes a glycan linked to N332 (Landais et al. 2016 PLoS Pathog. 12, e1005369). PGT121 and its somatic relatives are an exceptionally potent family of bnAbs that target this epitope and PGT121 has been shown to protect macaques in SHIV challenge studies (Walker et al. 2011 Nature. 477, 466-470, Moldt et al. 2012 Proc Natl Acad Sci. 109, 18921-18925). The elicitation of high and sustained titers of PGT121-like antibodies by vaccination would therefore have a reasonable likelihood of providing protection against HIV in humans.

HIV Env proteins show no detectable affinity for predicted germline precursors of PGT121, suggesting that activation of appropriate precursors is a barrier to PGT121-like bnAb induction that could be addressed by germline-targeting immunogen design. In this view, vaccine induction of PGT121-like bnAbs might be achieved by a germline-targeting prime followed by boosts with progressively more native-like Env, similar to what has been proposed for elicitation of VRC01-class bnAbs (Jardine, Julien, Menis et al. 2013 Science. 340, 711-716; McGuire et al 2013 J Exp Med. 210, 655-663; Jardine, Ota, Sok et al. 2015 Science. 349, 156-161). BG505 SOSIP.664 was the first soluble native-like Env trimer (Sanders et al. 2013 PloS Pathog. 9, e1003618). In parallel with Applicants' germline-targeting effort a goal was to improve the expression, stability and antigenic profile of BG505 SOSIP.664 in order to have an enhanced trimer platform for germline targeting and boosting. Using a lentivirus-based method for displaying libraries of immunogens on the surface of mammalian cells, and guided by the known structure of BG505 SOSIP.664 (Julien et al. 2013 Science. 342, 1477-1483; Lyumkis et al. 2013 Science. 342, 1484-1490; Pancera et al. 2014 Nature. 514, 455-461) Applicants have engineered a series of soluble native-like trimers with improved yield, thermostability and antigenic profile, which have progressively increasing affinity for putative PGT121 germline precursors and intermediately mutated antibodies.

Applicants have demonstrated that structure-guided mammalian cell surface display can be used to engineer trimers containing native-like glycans. Native-like trimers have been developed that bind to predicted PGT121 germline precursors and intermediately mutated antibodies BG505 SOSIP trimers were engineered with improved yield, thermostability and antigenic profile. Tests of priming and boosting strategies are currently underway in PGT121-GL knock-in mice.

Applicants claim sequences of different types of immunogen sequences. The sequences provided below are exemplary examples, the stabilizing mutations, modifications, (such as, but not limited to, cleavage-independent modifications), and/or a membrane anchoring strategy (such as, but not limited to, linker plus platelet-derived growth factor receptor (PDGFR)) described herein are applicable to any HIV strain or clade, such as but not limited to, those described below.

As used herein, at least three separate zoonotic transmissions resulted in the formation of three distinct HIV-1 groups: M (main), O (outlier), and N (non-M/non-O).

About 90% of HIV-1 infections are classified as group M and these are distributed worldwide. Group O infections are endemic to several west central African countries and represent 1 to 5% of all HIV-1 infection in those areas. Group N has only been identified in a small number of individuals in Cameroon.

Within the HIV-M group, there is a further division into at least ten subtypes or clades (groups of genetically related virus). Historically, the distribution of subtypes followed the geographic patterns listed below.

Clade or Subtype A: Central and East Africa as well as East European countries that were formerly part of the Soviet Union.

Clade or Subtype B: West and Central Europe, the Americas, Australia, South America, and several southeast Asian countries (Thailand, and Japan), as well as northern Africa and the Middle East.

Clade or Subtype C: Sub-Saharan Africa, India, and Brazil.

Clade or Subtype D: North Africa and the Middle East.

Clade or Subtype F: South and southeast Asia.

Clade or Subtype G: West and Central Africa.

Clade or Subtypes H, J, and K: Africa and the Middle East.

Additionally, different subtypes can combine genetic material to form a hybrid virus, known as a "circulating recombinant form" (CRFs), of which at least twenty have been identified (see, e.g., 2. Buonarguro L Human Immunodeficiency Virus Type 1 Subtype distribution in the worldwide epidemic: pathogenetic and therapeutic implications. J Virol 81(19):10209-19, 2007).

The present invention encompasses the stabilizing mutations, modifications, (such as, but not limited to, cleavage-independent modifications), and/or a membrane anchoring strategy (such as, but not limited to, linker plus platelet-derived growth factor receptor (PDGFR)) described herein to all groups and clades of HIV.

Types I and II are gp120 molecules (I) and gp140 trimer molecules (II) with mutations discovered to improve binding to germline-reverted and/or less-mutated versions of PGT121. The sequences in I and II can be employed in sequential immunization schemes to attempt to elicit PGT121-class bnAbs against HIV.

Type III are gp140 trimer molecules with stabilizing mutations to increase expression level and/or increase thermal melting temperature and/or improve antigenic profile, where a favorable antigenic profile means better affinity for broadly neutralizing antibodies and no or very weak affinity for non-neutralizing antibodies.

Type IV are combinations of mutations from II and III: these are gp140 trimers that contain both stabilizing mutations and germline-targeting mutations. In type IV Applicants have listed only a few important combinations, but the present invention encompasses all possible combinations of the mutations from II and III.

Type V are trimers with modified surfaces or of different strains than BG505, that can be employed in strategic boosting regimens.

Type VI are additional trimer modifications that add extra functionality and that can be combined with types II, III, IV or V.

Type VII are examples of native-like trimers from other HIV strains that have been stabilized by MD39 and Olio6 mutations, demonstrating the general applicability of the MD39 and Olio6 stabilizing mutations. FIG. 16A provides experimental data supporting these trimers as native-like.

Type VIII are variants of BG505 MD39 that do not require cleavage by furin. We refer to these as "cleavage-independent" trimers.

Type IX are glycan masked trimers in which N-linked glycosylation sites have been added to cover the bottom and sides of the soluble trimer.

Type X are native-like trimers with variable loops V1, V2b and V4 modified to both minimize their lengths and maximize the number of glycosylation sites contained within them.

Type XI are BG505 MD39-based, single-component, self-assembling nanoparticles.

Type XII are BG505 MD39-based, membrane-bound native like trimers.

Amino acid and nucleic acid sequences are listed below. In the amino acid sequences, mutations relative to a parent construct are generally indicated in bold.

I: gp120s with PGT121-Class Germline-Targeting Mutations

```
BG505-gp120-L111A-2_T135A_T139I_mC (BG505-gp120 3mut)
                                                         (SEQ ID NO: 1)
VWKDAETTLFCASDAKAYETEKHNVWATHACVPTDPNPQEIHLENVTEEFNMWKNNM

VEQMHTDIISAWDQSLKPCVKLTPLCVTLQCTNVANNIIDDMRGELKNCSFNMTTELRDKKQKV

YSLFYRLDVVQINENQGNRSNNSNKEYRLINCNTSAITQACPKVSFEPIPIHYCAPAGFAILKC

KDKKFNGTGPCPSVSTVQCTHGIKPVVSTQLLLNGSLAEEEVMIRSENITNNAKNILVQFNTPV

QINCTRPNNNTRKSIRIGPGQAFYATGDIIGDIRQAHCNVSKATWNETLGKVVKQLRKHFGNNT

IIRFANSSGGDLEVTTHSFNCGGEFFYCNTSGLFNSTWISNTSVQGSNSTGSNDSITLPCRIKQ

IINMWQRIGQAMYAPPIQGVIRCVSNITGLILTRDGGSTNSTTETFRPGGGDMRDNWRSELYKY

KVVKIEP
                                                         (SEQ ID NO: 2)
GTGTGGAAAGACGCCGAGACTACTCTGTTCTGTGCCAGCGACGCCAAAGCATACGAA

ACTGAAAAGCATAATGTGTGGGCTACTCACGCCTGCGTGCCCACAGACCCAAATCCCCAGGAA

TCCACCTGGAGAATGTCACTGAGGAATTCAACATGTGGAAGAACAATATGGTGGAGCAGATGCA

TACCGACATCATTTCAGCCTGGGATCAGAGCCTGAAGCCATGCGTGAAACTGACTCCCCTGTGC

GTCACCCTGCAGTGTACCAACGTGGCCAACAATATCATCGACGATATGCGGGGCGAACTGAAGA

ATTGTTCTTTCAACATGACCACAGAGCTGCGGGACAAGAAACAGAAAGTGTACAGTCTGTTTTA

TAGACTGGATGTGGTCCAGATCAATGAAAACCAGGGGAATCGATCCAACAATTCTAACAAGGAG

TACCGGCTGATCAATTGCAACACTAGCGCCATTACCCAGGCTTGTCCCAAAGTGTCCTTTGAAC

CTATCCCAATTCATTATTGCGCCCCTGCTGGCTTCGCCATCCTGAAGTGTAAAGATAAGAAGTT

CAACGGCACCGGGCCCTGCCCTTCTGTGAGTACAGTCCAGTGTACTCACGGGATTAAGCCTGTG

GTCAGTACACAGCTGCTGCTGAATGGATCACTGGCTGAGGAAGAAGTGATGATCCGATCCGAGA

ACATTACTAACAATGCAAAGAATATCCTGGTGCAGTTCAACACCCCTGTCCAGATTAATTGCAC

TCGCCCAAACAATAACACCCGGAAAAGCATCAGAATTGGACCAGGCCAGGCATTTTACGCCACC

GGGGACATCATTGGAGATATCAGACAGGCACACTGTAATGTGTCCAAGGCCACCTGGAACGAAA

CACTGGGAAAGGTGGTCAAACAGCTGAGAAAACATTTCGGCAATAACACTATCATTAGGTTTGC

TAATAGCTCCGGCGGGGACCTGGAAGTGACTACCCACAGCTTCAACTGCGGAGGCGAGTTCTTT

TACTGTAACACATCCGGCCTGTTTAATTCTACATGGATCAGTAACACTTCAGTGCAGGGCTCAA

ATAGCACCGGGAGCAACGATTCCATCACACTGCCTTGCCGCATTAAGCAGATCATTAATATGTG

GCAGCGAATTGGACAGGCTATGTATGCACCCCCTATCCAGGGCGTGATTAGATGTGTCTCTAAT

ATCACCGGGCTGATTCTGACACGCGACGGGGGATCTACAAACAGTACAACTGAGACTTTCAGGC
```

```
CAGGCGGGGAGACATGAGGGATAACTGGCGCAGCGAACTGTACAAGTATAAAGTGGTCAAAAT

CGAGCCC

BG505-gp120-L111A-2_5mut_mC (BG505-gp120 5mut)
                                                         (SEQ ID NO: 3)
VWKDAETTLFCASDAKAYETEKHNVWATHACVPTDPNPQEIHLENVTEEFNMWKNNM

VEQMHTDIISAWDQSLKPCVKLTPLCVTLQCTNYTPNLTNDMRGELKNCSFNMTTELRDKKQKV

YSLFYRLDVVQINENQGNRSNNSNKEYRLINCNTSAITQACPKVSFEPIPIHYCAPAGFAILKC

KDKKFNGTGPCPSVSTVQCTHGIKPVVSTQLLLNGSLAEEEVMIRSENITNNAKNILVQFNTPV

QINCTRPNNNTRKSIRIGPGQAFYATGDIIGDIRQAHCNVSKATWNETLGKVVKQLRKHFGNNT

IIRFANSSGGDLEVTTHSFNCGGEFFYCNTSGLFNSTWISNTSVQGSNSTGSNDSITLPCRIKQ

IINMWQRIGQAMYAPPIQGVIRCVSNITGLILTRDGGSTNSTTETFRPGGGDMRDNWRSELYKY

KVVKIEP (SEQ ID NO: 4)
GTGTGGAAAGACGCCGAGACTACTCTGTTCTGTGCCAGCGACGCCAAAGCATACGAA

ACTGAAAAGCATAATGTGTGGGCTACTCACGCCTGCGTGCCCACAGACCCAAATCCCCAGGAA

TCCACCTGGAGAATGTCACTGAGGAATTCAACATGTGGAAGAACAATATGGTGGAGCAGATGCA

TACCGACATCATTTCAGCCTGGGATCAGAGCCTGAAGCCATGCGTGAAACTGACTCCCCTGTGC

GTCACCCTGCAGTGTACCAACTACACACCCAATCTGACCAACGATATGCGGGGCGAACTGAAGA

ATTGTTCTTTCAACATGACCACAGAGCTGCGGGACAAGAAACAGAAAGTGTACAGTCTGTTTTA

TAGACTGGATGTGGTCCAGATCAATGAAAACCAGGGGAATCGATCCAACAATTCTAACAAGGAG

TACCGGCTGATCAATTGCAACACTAGCGCCATTACCCAGGCTTGTCCCAAAGTGTCCTTTGAAC

CTATCCCAATTCATTATTGCGCCCCTGCTGGCTTCGCCATCCTGAAGTGTAAAGATAAGAAGTT

CAACGGCACCGGGCCCTGCCCTTCTGTGAGTACAGTCCAGTGTACTCACGGGATTAAGCCTGTG

GTCAGTACACAGCTGCTGCTGAATGGATCACTGGCTGAGGAAGAAGTGATGATCCGATCCGAGA

ACATTACTAACAATGCAAAGAATATCCTGGTGCAGTTCAACACCCCTGTCCAGATTAATTGCAC

TCGCCCAAACAATAACACCCGGAAAAGCATCAGAATTGGACCAGGCCAGGCATTTTACGCCACC

GGGGACATCATTGGAGATATCAGACAGGCACACTGTAATGTGTCCAAGGCCACCTGGAACGAAA

CACTGGGAAAGGTGGTCAAACAGCTGAGAAAACATTTCGGCAATAACACTATCATTAGGTTTGC

TAATAGCTCCGGCGGGACCTGGAAGTGACTACCCACAGCTTCAACTGCGGAGGCGAGTTCTTT

TACTGTAACACATCCGGCCTGTTTAATTCTACATGGATCAGTAACACTTCAGTGCAGGGCTCAA

ATAGCACCGGGAGCAACGATTCCATCACACTGCCTTGCCGCATTAAGCAGATCATTAATATGTG

GCAGCGAATTGGACAGGCTATGTATGCACCCCCTATCCAGGGCGTGATTAGATGTGTCTCTAAT

ATCACCGGGCTGATTCTGACACGCGACGGGGGATCTACAAACAGTACAACTGAGACTTTCAGGC

CAGGCGGGGAGACATGAGGGATAACTGGCGCAGCGAACTGTACAAGTATAAAGTGGTCAAAAT

CGAGCCC

BG505-gp120-L111A-2_7mut_mC (BG505-gp120 7mut or BG505 gp120 7MUT)
                                                         (SEQ ID NO: 5)
VWKDAETTLFCASDAKAYETEKHNVWATHACVPTDPNPQEIHLENVTEEFNMWKNNM

VEQMHTDIISAWDQSLKPCVKLTPLCVTLQCTNYAPNLINDMRGELKNCSFNMTTELRDKKQKV

YSLFYRLDVVQINENQGNRSNNSNKEYRLINCNTSAITQACPKVSFEPIPIHYCAPAGFAILKC

KDKKFNGTGPCPSVSTVQCTHGIKPVVSTQLLLNGSLAEEEVMIRSENITNNAKNILVQFNTPV

QINCTRPNNNTRKSIRIGPGQAFYATGDIIGDIRQAHCNVSKATWNETLGKVVKQLRKHFGNNT

IIRFANSSGGDLEVTTHSFNCGGEFFYCNTSGLFNSTWISNTSVQGSNSTGSNDSITLPCRIKQ
```

-continued

IINMWQRIGQAMYAPPIQGVIRCVSNITGLILTRDGGSTNSTTETFRPGGGDMRDNWRSELYKY

KVVKIEP (SEQ ID NO: 6)
GTGTGGAAAGACGCCGAGACTACTCTGTTCTGTGCCAGCGACGCCAAAGCATACGAA

ACTGAAAAGCATAATGTGTGGGCTACTCACGCCTGCGTGCCCACAGACCCAAATCCCCAGGAA

TCCACCTGGAGAATGTCACTGAGGAATTCAACATGTGGAAGAACAATATGGTGGAGCAGATGCA

TACCGACATCATTTCAGCCTGGGATCAGAGCCTGAAGCCATGCGTGAAACTGACTCCCCTGTGC

GTCACCCTGCAGTGTACCAACTACGCCCCCAATCTGATCAACGATATGCGGGGCGAACTGAAGA

ATTGTTCTTTCAACATGACCACAGAGCTGCGGGACAAGAAACAGAAAGTGTACAGTCTGTTTTA

TAGACTGGATGTGGTCCAGATCAATGAAAACCAGGGGAATCGATCCAACAATTCTAACAAGGAG

TACCGGCTGATCAATTGCAACACTAGCGCCATTACCCAGGCTTGTCCCAAAGTGTCCTTTGAAC

CTATCCCAATTCATTATTGCGCCCCTGCTGGCTTCGCCATCCTGAAGTGTAAAGATAAGAAGTT

CAACGGCACCGGGCCCTGCCCTTCTGTGAGTACAGTCCAGTGTACTCACGGGATTAAGCCTGTG

GTCAGTACACAGCTGCTGCTGAATGGATCACTGGCTGAGGAAGAAGTGATGATCCGATCCGAGA

ACATTACTAACAATGCAAAGAATATCCTGGTGCAGTTCAACACCCCTGTCCAGATTAATTGCAC

TCGCCCAAACAATAACACCCGGAAAAGCATCAGAATTGGACCAGGCCAGGCATTTTACGCCACC

GGGGACATCATTGGAGATATCAGACAGGCACACTGTAATGTGTCCAAGGCCACCTGGAACGAAA

CACTGGGAAAGGTGGTCAAACAGCTGAGAAAACATTTCGGCAATAACACTATCATTAGGTTTGC

TAATAGCTCCGGCGGGGACCTGGAAGTGACTACCCACAGCTTCAACTGCGGAGGCGAGTTCTTT

TACTGTAACACATCCGGCCTGTTTAATTCTACATGGATCAGTAACACTTCAGTGCAGGGCTCAA

ATAGCACCGGGAGCAACGATTCCATCACACTGCCTTGCCGCATTAAGCAGATCATTAATATGTG

GCAGCGAATTGGACAGGCTATGTATGCACCCCCTATCCAGGGCGTGATTAGATGTGTCTCTAAT

ATCACCGGGCTGATTCTGACACGCGACGGGGATCTACAAACAGTACAACTGAGACTTTCAGGC

CAGGCGGGGAGACATGAGGGATAACTGGCGCAGCGAACTGTACAAGTATAAAGTGGTCAAAAT

CGAGCCC

BG505-gp120-L111A-2_10mut_mC (BG505-gp120 10mut or BG505 gp120
10MUT)

(SEQ ID NO: 7)
VWKDAETTLFCASDAKAYETEKHNVWATHACVPTDPNPQEIHLENVTEEFNMWKNNM

VEQMHTDIISAWDQSLKPCVKLTPLCVTLQCTNYAPFLINDMRGELKNCSFNMTTELRDKKQKV

YSLFYRLDVVQINENQGNRSNNSNKEYRLINCNTSAITQACPKVSFEPIPIHYCAPAGFAILKC

KDKKFNGTGPCPSVSTVQCTHGIKPVVSTQLLLNGSLAEEEVMIRSENITNNAKNILVQFNTPV

QINCTRPNNNTRKSIRIGPGQAFYAFGDIIGDIRMAHCNVSKATWNETLGKVVKQLRKHFGNNT

IIRFANSSGGDLEVTTHSFNCGGEFFYCNTSGLFNSTWISNTSVQGSNSTGSNDSITLPCRIKQ

IINMWQRIGQAMYAPPIQGVIRCVSNITGLILTRDGGSTNSTTETFRPGGGDMRDNWRSELYKY

KVVKIEP (SEQ ID NO: 8)
GTGTGGAAAGACGCCGAGACTACTCTGTTCTGTGCCAGCGACGCCAAAGCATACGAA

ACTGAAAAGCATAATGTGTGGGCTACTCACGCCTGCGTGCCCACAGACCCAAATCCCCAGGAA

TCCACCTGGAGAATGTCACTGAGGAATTCAACATGTGGAAGAACAATATGGTGGAGCAGATGCA

TACCGACATCATTTCAGCCTGGGATCAGAGCCTGAAGCCATGCGTGAAACTGACTCCCCTGTGC

GTCACCCTGCAGTGTACCAACTACGCCCCCTTCCTGATCAACGATATGCGGGGCGAACTGAAGA

ATTGTTCTTTCAACATGACCACAGAGCTGCGGGACAAGAAACAGAAAGTGTACAGTCTGTTTTA

-continued

```
TAGACTGGATGTGGTCCAGATCAATGAAAACCAGGGGAATCGATCCAACAATTCTAACAAGGAG

TACCGGCTGATCAATTGCAACACTAGCGCCATTACCCAGGCTTGTCCCAAAGTGTCCTTTGAAC

CTATCCCAATTCATTATTGCGCCCTGCTGGCTTCGCCATCCTGAAGTGTAAAGATAAGAAGTT

CAACGGCACCGGGCCCTGCCCTTCTGTGAGTACAGTCCAGTGTACTCACGGGATTAAGCCTGTG

GTCAGTACACAGCTGCTGCTGAATGGATCACTGGCTGAGGAAGAAGTGATGATCCGATCCGAGA

ACATTACTAACAATGCAAAGAATATCCTGGTGCAGTTCAACACCCCTGTCCAGATTAATTGCAC

TCGCCCAAACAATAACACCCGGAAAAGCATCAGAATTGGACCAGGCCAGGCATTTTACGCCTTC

GGGGACATCATTGGAGATATCAGAATGGCACACTGTAATGTGTCCAAGGCCACCTGGAACGAAA

CACTGGGAAAGGTGGTCAAACAGCTGAGAAAACATTTCGGCAATAACACTATCATTAGGTTTGC

TAATAGCTCCGGCGGGGACCTGGAAGTGACTACCCACAGCTTCAACTGCGGAGGCGAGTTCTTT

TACTGTAACACATCCGGCCTGTTTAATTCTACATGGATCAGTAACACTTCAGTGCAGGGCTCAA

ATAGCACCGGGAGCAACGATTCCATCACACTGCCTTGCCGCATTAAGCAGATCATTAATATGTG

GCAGCGAATTGGACAGGCTATGTATGCACCCCCTATCCAGGGCGTGATTAGATGTGTCTCTAAT

ATCACCGGGCTGATTCTGACACGCGACGGGGATCTACAAACAGTACAACTGAGACTTTCAGGC

CAGGCGGGGGAGACATGAGGGATAACTGGCGCAGCGAACTGTACAAGTATAAAGTGGTCAAAAT

CGAGCCC
```

BG505-gp120-L111A-2_10mut2A_mC (SEQ ID NO: 9)

VWKDAETTLFCASDAKAYETEKHNVWATHACVPTDPNPQEIHLENVTEEFNMWKNNM

VEQMHTDIISAWDQSLKPCVKLTPLCVTLQCTNYAPFLINNMRGELKNCSFNMTTELRDKKQKV

YSLFYRLDVVQINENQGNRSNNSNKEYRLINCNTSAITQACPKVSFEPIPIHYCAPAGFAILKC

KDKKFNGTGPCPSVSTVQCTHGIKPVVSTQLLLNGSLAEEEVMIRSENITNNAKNILVQFNTPV

QINCTRPNNNTRKSIRIGPGQAFYAFGDIIGDIRMAHCNVSKATWNETLGKVVKQLRKHFGNNT

IIRFANSSGGDLEVTTHSFNCGGEFFYCNTSGLFNSTWISNTSVQGSNSTGSNDSITLPCRIKQ

IINMWQRIGQAMYAPPIQGVIRCVSNITGLILTRDGGSTNSTTETFRPGGGDMRDNWRSELYKY

KVVKIEP (SEQ ID NO: 10)

```
GTGTGGAAAGACGCCGAGACTACTCTGTTCTGTGCCAGCGACGCCAAAGCATACGAA

ACTGAAAAGCATAATGTGTGGGCTACTCACGCCTGCGTGCCCACAGACCCAAATCCCCAGGAAA

TCCACCTGGAGAATGTCACTGAGGAATTCAACATGTGGAAGAACAATATGGTGGAGCAGATGCA

TACCGACATCATTTCAGCCTGGGATCAGAGCCTGAAGCCATGCGTGAAACTGACTCCCCTGTGC

GTCACCCTGCAGTGTACCAACTACGCCCCCTTCCTGATCAACAACATGCGGGGCGAACTGAAGA

ATTGTTCTTTCAACATGACCACAGAGCTGCGGGACAAGAAACAGAAAGTGTACAGTCTGTTTTA

TAGACTGGATGTGGTCCAGATCAATGAAAACCAGGGGAATCGATCCAACAATTCTAACAAGGAG

TACCGGCTGATCAATTGCAACACTAGCGCCATTACCCAGGCTTGTCCCAAAGTGTCCTTTGAAC

CTATCCCAATTCATTATTGCGCCCCTGCTGGCTTCGCCATCCTGAAGTGTAAAGATAAGAAGTT

CAACGGCACCGGGCCCTGCCCTTCTGTGAGTACAGTCCAGTGTACTCACGGGATTAAGCCTGTG

GTCAGTACACAGCTGCTGCTGAATGGATCACTGGCTGAGGAAGAAGTGATGATCCGATCCGAGA

ACATTACTAACAATGCAAAGAATATCCTGGTGCAGTTCAACACCCCTGTCCAGATTAATTGCAC

TCGCCCAAACAATAACACCCGGAAAAGCATCAGAATTGGACCAGGCCAGGCATTTTACGCCTTC

GGGGACATCATTGGAGATATCAGAATGGCACACTGTAATGTGTCCAAGGCCACCTGGAACGAAA

CACTGGGAAAGGTGGTCAAACAGCTGAGAAAACATTTCGGCAATAACACTATCATTAGGTTTGC
```

-continued

```
TAATAGCTCCGGCGGGGACCTGGAAGTGACTACCCACAGCTTCAACTGCGGAGGCGAGTTCTTT

TACTGTAACACATCCGGCCTGTTTAATTCTACATGGATCAGTAACACTTCAGTGCAGGGCTCAA

ATAGCACCGGGAGCAACGATTCCATCACACTGCCTTGCCGCATTAAGCAGATCATTAATATGTG

GCAGCGAATTGGACAGGCTATGTATGCACCCCCTATCCAGGGCGTGATTAGATGTGTCTCTAAT

ATCACCGGGCTGATTCTGACACGCGACGGGGGATCTACAAACAGTACAACTGAGACTTTCAGGC

CAGGCGGGGGAGACATGAGGGATAACTGGCGCAGCGAACTGTACAAGTATAAAGTGGTCAAAAT

CGAGCCC
```

BG505-gp120-L111A-2_11mut2A_mC (SEQ ID NO: 11)
```
VWKDAETTLFCASDAKAYETEKHNVWATHACVPTDPNPQEIHLENVTEEFNMWKNNM

VEQMHTDIISAWDQSLKPCVKLTPLCVTLQCTNYAPNLLSNMRGELKNCSFNMTTELRDKKQKV

YSLFYRLDVVQINENQGNRSNNSNKEYRLINCNTSAITQACPKVSFEPIPIHYCAPAGFAILKC

KDKKFNGTGPCPSVSTVQCTHGIKPVVSTQLLLNGSLAEEEVMIRSENITNNAKNILVQFNTPV

QINCTRPNNNTRKSIRIGPGQAFYAFGDIIGDIRMAHCNVSKATWNETLGKVVKQLRKHFGNNT

IIRFANSSGGDLEVTTHSFNCGGEFFYCNTSGLFNSTWISNTSVQGSNSTGSNDSIVIPCRIKQ

IINMWQRIGQAMYAPPIQGVIRCVSNITGLILTRDGGSTNSTTETFRPGGGDMRDNWRSELYKY

KVVKIEP
```

(SEQ ID NO: 12)
```
GTGTGGAAAGACGCCGAGACTACTCTGTTCTGTGCCAGCGACGCCAAAGCATACGAA

ACTGAAAAGCATAATGTGTGGGCTACTCACGCCTGCGTGCCCACAGACCCAAATCCCCAGGAA

TCCACCTGGAGAATGTCACTGAGGAATTCAACATGTGGAAGAACAATATGGTGGAGCAGATGCA

TACCGACATCATTTCAGCCTGGGATCAGAGCCTGAAGCCATGCGTGAAACTGACTCCCCTGTGC

GTCACCCTGCAGTGTACCAACTACGCCCCCAACCTGCTGAGCAACATGCGGGGCGAACTGAAGA

ATTGTTCTTTCAACATGACCACAGAGCTGCGGGACAAGAAACAGAAAGTGTACAGTCTGTTTTA

TAGACTGGATGTGGTCCAGATCAATGAAAACCAGGGGAATCGATCCAACAATTCTAACAAGGAG

TACCGGCTGATCAATTGCAACACTAGCGCCATTACCCAGGCTTGTCCCAAAGTGTCCTTTGAAC

CTATCCCAATTCATTATTGCGCCCCTGCTGGCTTCGCCATCCTGAAGTGTAAAGATAAGAAGTT

CAACGGCACCGGCCCTGCCCTTCTGTGAGTACAGTCCAGTGTACTCACGGGATTAAGCCTGTG

GTCAGTACACAGCTGCTGCTGAATGGATCACTGGCTGAGGAAGAAGTGATGATCCGATCCGAGA

ACATTACTAACAATGCAAAGAATATCCTGGTGCAGTTCAACACCCCTGTCCAGATTAATTGCAC

TCGCCCAAACAATAACACCCGGAAAAGCATCAGAATTGGACCAGGCCAGGCATTTTACGCCTTC

GGGGACATCATTGGAGATATCAGAATGGCACACTGTAATGTGTCCAAGGCCACCTGGAACGAAA

CACTGGGAAAGGTGGTCAAACAGCTGAGAAAACATTTCGGCAATAACACTATCATTAGGTTTGC

TAATAGCTCCGGCGGGGACCTGGAAGTGACTACCCACAGCTTCAACTGCGGAGGCGAGTTCTTT

TACTGTAACACATCCGGCCTGTTTAATTCTACATGGATCAGTAACACTTCAGTGCAGGGCTCAA

ATAGCACCGGGAGCAACGATTCCATCGTGCTGCCTTGCCGCATTAAGCAGATCATTAATATGTG

GCAGCGAATTGGACAGGCTATGTATGCACCCCCTATCCAGGGCGTGATTAGATGTGTCTCTAAT

ATCACCGGGCTGATTCTGACACGCGACGGGGGATCTACAAACAGTACAACTGAGACTTTCAGGC

CAGGCGGGGGAGACATGAGGGATAACTGGCGCAGCGAACTGTACAAGTATAAAGTGGTCAAAAT

CGAGCCC
```

II: Trimers with PGT121-Class Germline-Targeting Mutations

BG505_SOSIP.D664_JS_3mut_mC (SOSIP-3MUT)
(SEQ ID NO: 13)
AENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQ
CTNVANNIIDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVMIRSENITNN
AKNILVQFNTPVQINCTRPNNNTRKSIRIGPGQAFYATGDIIGDIRQAHC
NVSKATWNETLGKVVKQLRKHFGNNTIIRFANSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALD (SEQ ID NO: 14)

GCTGAAAACCTGTGGGTCACTGTCTACTACGGCGTGCCTGTCTGGAAGGA
TGCTGAAACTACTCTGTTCTGTGCCTCTGATGCTAAAGCCTACGAAACCG
AGAAGCACAATGTGTGGGCCACACATGCTTGCGTCCCTACTGACCCAAAC
CCCCAGGAAATCCACCTGGAGAATGTGACAGAGGAATTCAACATGTGGAA
AAACAATATGGTGGAGCAGATGCATACTGACATCATTTCCCTGTGGGATC
AGTCTCTGAAGCCTTGCGTGAAACTGACACCACTGTGCGTCACTCTGCAG
TGTACTAACGTGGCCAACAATATCATCGACGATATGCGGGGCGAACTGAA
GAATTGTTCTTTCAACATGACCACAGAGCTGCGGGACAAGAAACAGAAAG
TGTACAGTCTGTTTTATAGACTGGATGTGGTCCAGATCAATGAAAACCAG
GGGAATCGAAGTAACAATTCAAACAAGGAGTACCGGCTGATCAATTGCAA
CACAAGTGCAATTACTCAGGCCTGTCCAAAAGTGTCATTTGAACCTATCC
CAATTCATTATTGCGCTCCCGCAGGCTTCGCCATCCTGAAGTGTAAAGAT
AAGAAGTTCAACGGCACCGGGCCATGCCCTTCAGTGAGCACCGTCCAGTG
TACACACGGAATTAAGCCAGTGGTCTCCACACAGCTGCTGCTGAATGGCT
CTCTGGCTGAGGAAGAAGTGATGATCAGGAGCGAGAACATTACCAACAAT
GCAAAGAATATCCTGGTGCAGTTCAACACACCCGTCCAGATTAATTGCAC
CCGCCCTAACAATAACACACGGAAATCTATCAGAATTGGACCCGGCCAGG
CATTTTATGCCACCGGCGACATCATTGGGGATATCAGACAGGCACACTGT
AATGTGAGCAAGGCCACTTGGAACGAGACCCTGGGGAAGGTGGTCAAACA
GCTGAGAAAGCATTTCGGAAACAACACTATCATCAGGTTTGCCAATAGCT
CCGGCGGGGACCTGGAAGTGACTACCCACAGCTTCAACTGCGGAGGCGAG
TTCTTTTACTGTAACACAAGTGGCCTGTTTAATTCAACCTGGATCAGCAA
CACATCCGTGCAGGGATCCAATTCTACAGGCTCTAACGATAGTATCACTC
TGCCCTGCCGCATTAAGCAGATCATTAATATGTGGCAGCGAATCGGGCAG

-continued

GCTATGTATGCACCCCCTATCCAGGGAGTGATTAGATGTGTCAGCAATAT
CACTGGCCTGATTCTGACCCGCGACGGGGGATCAACTAACAGCACAACTG
AGACCTTCCGGCCTGGAGGAGGAGACATGAGGGATAACTGGCGCTCCGAA
CTGTACAAGTATAAAGTGGTCAAGATCGAGCCACTGGGAGTGGCACCAAC
CAGATGCAAACGAAGAGTGGTCGGAAGGCGACGACGAAGAAGGGCAGTGG
GAATTGGAGCTGTCTTCCTGGGCTTTCTGGGGGCCGCTGGATCTACAATG
GGGGCAGCCAGTATGACCCTGACAGTCCAGGCTCGAAATCTGCTGTCAGG
AATCGTGCAGCAGCAGAGCAACCTGCTGAGAGCCCCTGAAGCTCAGCAGC
ATCTGCTGAAGCTGACCGTGTGGGGCATCAAGCAGCTGCAGGCTAGGGTG
CTGGCAGTCGAGCGCTACCTGCGAGATCAGCAGCTGCTGGGCATCTGGGG
GTGTTCCGGAAAGCTGATTTGCTGTACCAATGTGCCATGGAACTCTAGTT
GGAGCAATCGCAACCTGTCCGAAATCTGGGACAATATGACTTGGCTGCAG
TGGGATAAGGAGATTAGCAACTACACCCAGATCATCTACGGCCTGCTGGA
AGAGTCCCAGAATCAGCAGGAGAAGAACGAGCAGGACCTGCTGGCCCTGG
AT

BG505_SOSIP.D664_JS_5mut_mC (SOSIP-5MUT)

(SEQ ID NO: 15)

AENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQ
CTNYTPNLTNDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVMIRSENITNN
AKNILVQFNTPVQINCTRPNNNTRKSIRIGPGQAFYATGDIIGDIRQAHC
NVSKATWNETLGKVVKQLRKHFGNNTIIRFANSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALD (SEQ ID NO: 16)

GCTGAAAACCTGTGGGTCACTGTCTACTACGGCGTGCCTGTCTGGAAGGA
TGCTGAAACTACTCTGTTCTGTGCCTCTGATGCTAAAGCCTACGAAACCG
AGAAGCACAATGTGTGGGCCACACATGCTTGCGTCCCTACTGACCCAAAC
CCCCAGGAAATCCACCTGGAGAATGTGACAGAGGAATTCAACATGTGGAA
AAACAATATGGTGGAGCAGATGCATACTGACATCATTTCCCTGTGGGATC
AGTCTCTGAAGCCTTGCGTGAAACTGACACCACTGTGCGTCACTCTGCAG
TGTACTAACTACACCCCCAATCTGACCAACGATATGCGGGGCGAACTGAA
GAATTGTTCTTTCAACATGACCACAGAGCTGCGGGACAAGAAACAGAAAG
TGTACAGTCTGTTTTATAGACTGGATGTGGTCCAGATCAATGAAAACCAG
GGGAATCGAAGTAACAATTCAAACAAGGAGTACCGGCTGATCAATTGCAA
CACAAGTGCAATTACTCAGGCCTGTCCAAAAGTGTCATTTGAACCTATCC

-continued

```
CAATTCATTATTGCGCTCCCGCAGGCTTCGCCATCCTGAAGTGTAAAGAT
AAGAAGTTCAACGGCACCGGGCCATGCCCTTCAGTGAGCACCGTCCAGTG
TACACACGGAATTAAGCCAGTGGTCTCCACACAGCTGCTGCTGAATGGCT
CTCTGGCTGAGGAAGAAGTGATGATCAGGAGCGAGAACATTACCAACAAT
GCAAAGAATATCCTGGTGCAGTTCAACACACCCGTCCAGATTAATTGCAC
CCGCCCTAACAATAACACACGGAAATCTATCAGAATTGGACCCGGCCAGG
CATTTTATGCCACCGGCGACATCATTGGGGATATCAGACAGGCACACTGT
AATGTGAGCAAGGCCACTTGGAACGAGACCCTGGGGAAGGTGGTCAAACA
GCTGAGAAAGCATTTCGGAAACAACACTATCATCAGGTTTGCCAATAGCT
CCGGCGGGGACCTGGAAGTGACTACCCACAGCTTCAACTGCGGAGGCGAG
TTCTTTTACTGTAACACAAGTGGCCTGTTTAATTCAACCTGGATCAGCAA
CACATCCGTGCAGGGATCCAATTCTACAGGCTCTAACGATAGTATCACTC
TGCCCTGCCGCATTAAGCAGATCATTAATATGTGGCAGCGAATCGGGCAG
GCTATGTATGCACCCCCTATCCAGGGAGTGATTAGATGTGTCAGCAATAT
CACTGGCCTGATTCTGACCCGCGACGGGGATCAACTAACAGCACAACTG
AGACCTTCCGGCCTGGAGGAGGAGACATGAGGGATAACTGGCGCTCCGAA
CTGTACAAGTATAAAGTGGTCAAGATCGAGCCACTGGGAGTGGCACCAAC
CAGATGCAAACGAAGAGTGGTCGGAAGGCGACGACGAAGAAGGGCAGTGG
GAATTGGAGCTGTCTTCCTGGGCTTTCTGGGGCCGCTGGATCTACAATG
GGGGCAGCCAGTATGACCCTGACAGTCCAGGCTCGAAATCTGCTGTCAGG
AATCGTGCAGCAGCAGAGCAACCTGCTGAGAGCCCCTGAAGCTCAGCAGC
ATCTGCTGAAGCTGACCGTGTGGGGCATCAAGCAGCTGCAGGCTAGGGTG
CTGGCAGTCGAGCGCTACCTGCGAGATCAGCAGCTGCTGGGCATCTGGGG
GTGTTCCGGAAAGCTGATTTGCTGTACCAATGTGCCATGGAACTCTAGTT
GGAGCAATCGCAACCTGTCCGAAATCTGGGACAATATGACTTGGCTGCAG
TGGGATAAGGAGATTAGCAACTACACCCAGATCATCTACGGCCTGCTGGA
AGAGTCCCAGAATCAGCAGGAGAAGAACGAGCAGGACCTGCTGGCCCTGG
AT
```

BG505_SOSIP.D664_JS_7mut_mC (SOSIP-7MUT)

(SEQ ID NO: 17)
AENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQ
CTNYAPNLINDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVMIRSENITNN
AKNILVQFNTPVQINCTRPNNNTRKSIRIGPGQAFYATGDIIGDIRQAHC
NVSKATWNETLGKVVKQLRKHFGNNTIIRFANSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVFLGFLGAAGSTM

GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALD (SEQ ID NO: 18)
```
GCTGAAAACCTGTGGGTCACTGTCTACTACGGCGTGCCTGTCTGGAAGGA
TGCTGAAACTACTCTGTTCTGTGCCTCTGATGCTAAAGCCTACGAAACCG
AGAAGCACAATGTGTGGGCCACACATGCTTGCGTCCCTACTGACCCAAAC
CCCCAGGAAATCCACCTGGAGAATGTGACAGAGGAATTCAACATGTGGAA
AAACAATATGGTGGAGCAGATGCATACTGACATCATTTCCCTGTGGGATC
AGTCTCTGAAGCCTTGCGTGAAACTGACACCACTGTGCGTCACTCTGCAG
TGTACTAACTACGCCCCCAATCTGATCAACGATATGCGGGGCGAACTGAA
GAATTGTTCTTTCAACATGACCACAGAGCTGCGGGACAAGAAACAGAAAG
TGTACAGTCTGTTTTATAGACTGGATGTGGTCCAGATCAATGAAAACCAG
GGGAATCGAAGTAACAATTCAAACAAGGAGTACCGGCTGATCAATTGCAA
CACAAGTGCAATTACTCAGGCCTGTCCAAAAGTGTCATTTGAACCTATCC
CAATTCATTATTGCGCTCCCGCAGGCTTCGCCATCCTGAAGTGTAAAGAT
AAGAAGTTCAACGGCACCGGGCCATGCCCTTCAGTGAGCACCGTCCAGTG
TACACACGGAATTAAGCCAGTGGTCTCCACACAGCTGCTGCTGAATGGCT
CTCTGGCTGAGGAAGAAGTGATGATCAGGAGCGAGAACATTACCAACAAT
GCAAAGAATATCCTGGTGCAGTTCAACACACCCGTCCAGATTAATTGCAC
CCGCCCTAACAATAACACACGGAAATCTATCAGAATTGGACCCGGCCAGG
CATTTTATGCCACCGGCGACATCATTGGGGATATCAGACAGGCACACTGT
AATGTGAGCAAGGCCACTTGGAACGAGACCCTGGGGAAGGTGGTCAAACA
GCTGAGAAAGCATTTCGGAAACAACACTATCATCAGGTTTGCCAATAGCT
CCGGCGGGGACCTGGAAGTGACTACCCACAGCTTCAACTGCGGAGGCGAG
TTCTTTTACTGTAACACAAGTGGCCTGTTTAATTCAACCTGGATCAGCAA
CACATCCGTGCAGGGATCCAATTCTACAGGCTCTAACGATAGTATCACTC
TGCCCTGCCGCATTAAGCAGATCATTAATATGTGGCAGCGAATCGGGCAG
GCTATGTATGCACCCCCTATCCAGGGAGTGATTAGATGTGTCAGCAATAT
CACTGGCCTGATTCTGACCCGCGACGGGGATCAACTAACAGCACAACTG
AGACCTTCCGGCCTGGAGGAGGAGACATGAGGGATAACTGGCGCTCCGAA
CTGTACAAGTATAAAGTGGTCAAGATCGAGCCACTGGGAGTGGCACCAAC
CAGATGCAAACGAAGAGTGGTCGGAAGGCGACGACGAAGAAGGGCAGTGG
GAATTGGAGCTGTCTTCCTGGGCTTTCTGGGGCCGCTGGATCTACAATG
GGGGCAGCCAGTATGACCCTGACAGTCCAGGCTCGAAATCTGCTGTCAGG
AATCGTGCAGCAGCAGAGCAACCTGCTGAGAGCCCCTGAAGCTCAGCAGC
ATCTGCTGAAGCTGACCGTGTGGGGCATCAAGCAGCTGCAGGCTAGGGTG
CTGGCAGTCGAGCGCTACCTGCGAGATCAGCAGCTGCTGGGCATCTGGGG
GTGTTCCGGAAAGCTGATTTGCTGTACCAATGTGCCATGGAACTCTAGTT
GGAGCAATCGCAACCTGTCCGAAATCTGGGACAATATGACTTGGCTGCAG
```

-continued

TGGGATAAGGAGATTAGCAACTACACCCAGATCATCTACGGCCTGCTGGA

AGAGTCCCAGAATCAGCAGGAGAAGAACGAGCAGGACCTGCTGGCCCTGG

AT

BG505_SOSIP.D664_JS_10mut_mC (SOSIP-10MUT)
(SEQ ID NO: 19)
AENLWVTVYYGVPVWKDAETTLFCASDAKAYETEKHNVWATHACVPTDPN

PQEIHLENVTEEFNMWKNNMVEQMHTDIISLWDQSLKPCVKLTPLCVTLQ

CTNYAPFLINDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVMIRSENITNN

AKNILVQFNTPVQINCTRPNNNTRKSIRIGPGQAFYAFGDIIGDIRMAHC

NVSKATWNETLGKVVKQLRKHFGNNTIIRFANSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVFLGFLGAAGSTM

GAASMTLTVQARNLLSGIVQQQSNLLRAPEAQQHLLKLTVWGIKQLQARV

LAVERYLRDQQLLGIWGCSGKLICCTNVPWNSSWSNRNLSEIWDNMTWLQ

WDKEISNYTQIIYGLLEESQNQQEKNEQDLLALD (SEQ ID NO: 20)
GCTGAAAACCTGTGGGTCACTGTCTACTACGGCGTGCCTGTCTGGAAGGA

TGCTGAAACTACTCTGTTCTGTGCCTCTGATGCTAAAGCCTACGAAACCG

AGAAGCACAATGTGTGGGCCACACATGCTTGCGTCCCTACTGACCCAAAC

CCCCAGGAAATCCACCTGGAGAATGTGACAGAGGAATTCAACATGTGGAA

AAACAATATGGTGGAGCAGATGCATACTGACATCATTTCCCTGTGGGATC

AGTCTCTGAAGCCTTGCGTGAAACTGACACCACTGTGCGTCACTCTGCAG

TGTACTAACTACGCCCCCTTTCTGATCAACGATATGCGGGGCGAACTGAA

GAATTGTTCTTTCAACATGACCACAGAGCTGCGGGACAAGAAACAGAAAG

TGTACAGTCTGTTTTATAGACTGGATGTGGTCCAGATCAATGAAAACCAG

GGGAATCGAAGTAACAATTCAAACAAGGAGTACCGGCTGATCAATTGCAA

CACAAGTGCAATTACTCAGGCCTGTCCAAAAGTGTCATTTGAACCTATCC

CAATTCATTATTGCGCTCCCGCAGGCTTCGCCATCCTGAAGTGTAAAGAT

AAGAAGTTCAACGGCACCGGGCCATGCCCTTCAGTGAGCACCGTCCAGTG

TACACACGGAATTAAGCCAGTGGTCTCCACACAGCTGCTGCTGAATGGCT

CTCTGGCTGAGGAAGAAGTGATGATCAGGAGCGAGAACATTACCAACAAT

GCAAAGAATATCCTGGTGCAGTTCAACACACCCGTCCAGATTAATTGCAC

CCGCCCTAACAATAACACACGGAAATCTATCAGAATTGGACCCGGCCAGG

CATTTTATGCCTTTGGCGACATCATTGGGGATATCAGAATGGCACACTGT

AATGTGAGCAAGGCCACTTGGAACGAGACCCTGGGGAAGGTGGTCAAACA

GCTGAGAAAGCATTTCGGAAACAACACTATCATCAGGTTTGCCAATAGCT

CCGGCGGGGACCTGGAAGTGACTACCCACAGCTTCAACTGCGGAGGCGAG

TTCTTTTACTGTAACACAAGTGGCCTGTTTAATTCAACCTGGATCAGCAA

CACATCCGTGCAGGGATCCAATTCTACAGGCTCTAACGATAGTATCACTC

TGCCCTGCCGCATTAAGCAGATCATTAATATGTGGCAGCGAATCGGGCAG

GCTATGTATGCACCCCCTATCCAGGGAGTGATTAGATGTGTCAGCAATAT

CACTGGCCTGATTCTGACCCGCGACGGGGATCAACTAACAGCACAACTG

AGACCTTCCGGCCTGGAGGAGGAGACATGAGGGATAACTGGCGCTCCGAA

CTGTACAAGTATAAAGTGGTCAAGATCGAGCCACTGGGAGTGGCACCAAC

CAGATGCAAACGAAGAGTGGTCGGAAGGCGACGACGAAGAAGGGCAGTGG

GAATTGGAGCTGTCTTCCTGGGCTTTCTGGGGGCCGCTGGATCTACAATG

GGGGCAGCCAGTATGACCCTGACAGTCCAGGCTCGAAATCTGCTGTCAGG

AATCGTGCAGCAGAGCAACCTGCTGAGAGCCCCTGAAGCTCAGCAGC

ATCTGCTGAAGCTGACCGTGTGGGGCATCAAGCAGCTGCAGGCTAGGGTG

CTGGCAGTCGAGCGCTACCTGCGAGATCAGCAGCTGCTGGGCATCTGGGG

GTGTTCCGGAAAGCTGATTTGCTGTACCAATGTGCCATGGAACTCTAGTT

GGAGCAATCGCAACCTGTCCGAAATCTGGGACAATATGACTTGGCTGCAG

TGGGATAAGGAGATTAGCAACTACACCCAGATCATCTACGGCCTGCTGGA

AGAGTCCCAGAATCAGCAGGAGAAGAACGAGCAGGACCTGCTGGCCCTGG

AT

BG505_SOSIP.D664_JS_10mut2A_mC
(SEQ ID NO: 21)
AENLWVTVYYGVPVWKDAETTLFCASDAKAYETEKHNVWATHACVPTDPN

PQEIHLENVTEEFNMWKNNMVEQMHTDIISLWDQSLKPCVKLTPLCVTLQ

CTNYAPFLINNMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVMIRSENITNN

AKNILVQFNTPVQINCTRPNNNTRKSIRIGPGQAFYAFGDIIGDIRMAHC

NVSKATWNETLGKVVKQLRKHFGNNTIIRFANSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVFLGFLGAAGSTM

GAASMTLTVQARNLLSGIVQQQSNLLRAPEAQQHLLKLTVWGIKQLQARV

LAVERYLRDQQLLGIWGCSGKLICCTNVPWNSSWSNRNLSEIWDNMTWLQ

WDKEISNYTQIIYGLLEESQNQQEKNEQDLLALD (SEQ ID NO: 22)
GCTGAAAACCTGTGGGTCACTGTCTACTACGGCGTGCCTGTCTGGAAGGA

TGCTGAAACTACTCTGTTCTGTGCCTCTGATGCTAAAGCCTACGAAACCG

AGAAGCACAATGTGTGGGCCACACATGCTTGCGTCCCTACTGACCCAAAC

CCCCAGGAAATCCACCTGGAGAATGTGACAGAGGAATTCAACATGTGGAA

AAACAATATGGTGGAGCAGATGCATACTGACATCATTTCCCTGTGGGATC

AGTCTCTGAAGCCTTGCGTGAAACTGACACCACTGTGCGTCACTCTGCAG

TGTACTAACTACGCCCCCTTTCTGATCAACAACATGCGGGGCGAACTGAA

GAATTGTTCTTTCAACATGACCACAGAGCTGCGGGACAAGAAACAGAAAG

TGTACAGTCTGTTTTATAGACTGGATGTGGTCCAGATCAATGAAAACCAG

GGGAATCGAAGTAACAATTCAAACAAGGAGTACCGGCTGATCAATTGCAA

```
CACAAGTGCAATTACTCAGGCCTGTCCAAAAGTGTCATTTGAACCTATCC
CAATTCATTATTGCGCTCCCGCAGGCTTCGCCATCCTGAAGTGTAAAGAT
AAGAAGTTCAACGGCACCGGGCCATGCCCTTCAGTGAGCACCGTCCAGTG
TACACACGGAATTAAGCCAGTGGTCTCCACACAGCTGCTGCTGAATGGCT
CTCTGGCTGAGGAAGAAGTGATGATCAGGAGCGAGAACATTACCAACAAT
GCAAAGAATATCCTGGTGCAGTTCAACACACCCGTCCAGATTAATTGCAC
CCGCCCTAACAATAACACACGGAAATCTATCAGAATTGGACCCGGCCAGG
CATTTTATGCCTTTGGCGACATCATTGGGGATATCAGAATGGCACACTGT
AATGTGAGCAAGGCCACTTGGAACGAGACCCTGGGGAAGGTGGTCAAACA
GCTGAGAAAGCATTTCGGAAACAACACTATCATCAGGTTTGCCAATAGCT
CCGGCGGGGACCTGGAAGTGACTACCCACAGCTTCAACTGCGGAGGCGAG
TTCTTTTACTGTAACACAAGTGGCCTGTTTAATTCAACCTGGATCAGCAA
CACATCCGTGCAGGGATCCAATTCTACAGGCTCTAACGATAGTATCACTC
TGCCCTGCCGCATTAAGCAGATCATTAATATGTGGCAGCGAATCGGGCAG
GCTATGTATGCACCCCCTATCCAGGGAGTGATTAGATGTGTCAGCAATAT
CACTGGCCTGATTCTGACCCGCGACGGGGATCAACTAACAGCACAACTG
AGACCTTCCGGCCTGGAGGAGGAGACATGAGGGATAACTGGCGCTCCGAA
CTGTACAAGTATAAAGTGGTCAAGATCGAGCCACTGGGAGTGGCACCAAC
CAGATGCAAACGAAGAGTGGTCGGAAGGCGACGACGAAGAAGGGCAGTGG
GAATTGGAGCTGTCTTCCTGGGCTTTCTGGGGGCCGCTGGATCTACAATG
GGGGCAGCCAGTATGACCCTGACAGTCCAGGCTCGAAATCTGCTGTCAGG
AATCGTGCAGCAGCAGAGCAACCTGCTGAGAGCCCCTGAAGCTCAGCAGC
ATCTGCTGAAGCTGACCGTGTGGGGCATCAAGCAGCTGCAGGCTAGGGTG
CTGGCAGTCGAGCGCTACCTGCGAGATCAGCAGCTGCTGGGCATCTGGGG
GTGTTCCGGAAAGCTGATTTGCTGTACCAATGTGCCATGGAACTCTAGTT
GGAGCAATCGCAACCTGTCCGAAATCTGGGACAATATGACTTGGCTGCAG
TGGGATAAGGAGATTAGCAACTACACCCAGATCATCTACGGCCTGCTGGA
AGAGTCCCAGAATCAGCAGGAGAAGAACGAGCAGGACCTGCTGGCCCTGG
AT
```

BG505_SOSIP.D664_JS_11mut2A_mC (SEQ ID NO: 23)
AENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQ
CTNYAPNLLSNMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVMIRSENITNN
AKNILVQFNTPVQINCTRPNNNTRKSIRIGPGQAFYAFGDIIGDIRMAHC
NVSKATWNETLGKVVKQLRKHFGNNTIIRFANSSGGDLEVTTHSFNCGGE
FFYCNTSGLFNSTWISNTSVQGSNSTGSNDSIVLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVFLGFLGAAGSTM GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALD (SEQ ID NO: 24)
```
GCTGAAAACCTGTGGGTCACTGTCTACTACGGCGTGCCTGTCTGGAAGGA
TGCTGAAACTACTCTGTTCTGTGCCTCTGATGCTAAAGCCTACGAAACCG
AGAAGCACAATGTGTGGGCCACACATGCTTGCGTCCCTACTGACCCAAAC
CCCCAGGAAATCCACCTGGAGAATGTGACAGAGGAATTCAACATGTGGAA
AAACAATATGGTGGAGCAGATGCATACTGACATCATTTCCCTGTGGGATC
AGTCTCTGAAGCCTTGCGTGAAACTGACACCACTGTGCGTCACTCTGCAG
TGTACTAACTACGCCCCAAACCTGCTGTCCAATATGCGGGGCGAACTGAA
GAATTGTTCTTTCAACATGACCACAGAGCTGCGGGACAAGAAACAGAAAG
TGTACAGTCTGTTTTATAGACTGGATGTGGTCCAGATCAATGAAAACCAG
GGGAATCGAAGTAACAATTCAAACAAGGAGTACCGGCTGATCAATTGCAA
CACAAGTGCAATTACTCAGGCCTGTCCAAAAGTGTCATTTGAACCTATCC
CAATTCATTATTGCGCTCCCGCAGGCTTCGCCATCCTGAAGTGTAAAGAT
AAGAAGTTCAACGGCACCGGGCCATGCCCTTCAGTGAGCACCGTCCAGTG
TACACACGGAATTAAGCCAGTGGTCTCCACACAGCTGCTGCTGAATGGCT
CTCTGGCTGAGGAAGAAGTGATGATCAGGAGCGAGAACATTACCAACAAT
GCAAAGAATATCCTGGTGCAGTTCAACACACCCGTCCAGATTAATTGCAC
CCGCCCTAACAATAACACACGGAAATCTATCAGAATTGGACCCGGCCAGG
CATTTTATGCCTTTGGCGACATCATTGGGGATATCAGAATGGCACACTGT
AATGTGAGCAAGGCCACTTGGAACGAGACCCTGGGGAAGGTGGTCAAACA
GCTGAGAAAGCATTTCGGAAACAACACTATCATCAGGTTTGCCAATAGCT
CCGGCGGGGACCTGGAAGTGACTACCCACAGCTTCAACTGCGGAGGCGAG
TTCTTTTACTGTAACACAAGTGGCCTGTTTAATTCAACCTGGATCAGCAA
CACATCCGTGCAGGGATCCAATTCTACAGGCTCTAACGATAGTATCGTGC
TGCCCTGCCGCATTAAGCAGATCATTAATATGTGGCAGCGAATCGGGCAG
GCTATGTATGCACCCCCTATCCAGGGAGTGATTAGATGTGTCAGCAATAT
CACTGGCCTGATTCTGACCCGCGACGGGGATCAACTAACAGCACAACTG
AGACCTTCCGGCCTGGAGGAGGAGACATGAGGGATAACTGGCGCTCCGAA
CTGTACAAGTATAAAGTGGTCAAGATCGAGCCACTGGGAGTGGCACCAAC
CAGATGCAAACGAAGAGTGGTCGGAAGGCGACGACGAAGAAGGGCAGTGG
GAATTGGAGCTGTCTTCCTGGGCTTTCTGGGGGCCGCTGGATCTACAATG
GGGGCAGCCAGTATGACCCTGACAGTCCAGGCTCGAAATCTGCTGTCAGG
AATCGTGCAGCAGCAGAGCAACCTGCTGAGAGCCCCTGAAGCTCAGCAGC
ATCTGCTGAAGCTGACCGTGTGGGGCATCAAGCAGCTGCAGGCTAGGGTG
CTGGCAGTCGAGCGCTACCTGCGAGATCAGCAGCTGCTGGGCATCTGGGG
GTGTTCCGGAAAGCTGATTTGCTGTACCAATGTGCCATGGAACTCTAGTT
```

```
GGAGCAATCGCAACCTGTCCGAAATCTGGGACAATATGACTTGGCTGCAG

TGGGATAAGGAGATTAGCAACTACACCCAGATCATCTACGGCCTGCTGGA
```
```
AGAGTCCCAGAATCAGCAGGAGAAGAACGAGCAGGACCTGCTGGCCCTGG

AT
```

III: Stabilized Trimers with Improved Expression, Thermal Stability, and/or Antigenic Profile for Mature bnAbs

```
BG505_SOSIP_D664_MD39_mC (BG505 SOSIP-MD39 or MD39)
                                              (SEQ ID NO: 25)
AENLWVTVYYGVPVWKDAETTLFCASDAKAYETEKHNVWATHACVPTDPNPQEIHLE

NVTEEFNMWKNNMVEQMHEDIISLWDQSLKPCVKLTPLCVTLQCTNVTNNITDDMRGELKNCSF

NMTTELRDKKQKVYSLFYRLDVVQINENQGNRSNNSNKEYRLINCNTSAITQACPKVSFEPIPI

HYCAPAGFAILKCKDKKFNGTGPCPSVSTVQCTHGIKPVVSTQLLLNGSLAEEEVIIRSENITN

NAKNILVQLNTPVQINCTRPNNNTVKSIRIGPGQAFYYTGDIIGDIRQAHCNVSKATWNETLGK

VVKQLRKHFGNNTIIRFAQSSGGDLEVTTHSFNCGGEFFYCNTSGLFNSTWISNTSVQGSNSTG

SNDSITLPCRIKQIINMWQRIGQAMYAPPIQGVIRCVSNITGLILTRDGGSTNSTTETFRPGGG

DMRDNWRSELYKYKVVKIEPLGVAPTRCKRRVVGRRRRRRAVGIGAVSLGFLGAAGSTMGAASM

TLTVQARNLLSGIVQQQSNLLRAPEPQQHLLKDTHWGIKQLQARVLAVEHYLRDQQLLGIWGCS

GKLICCTNVPWNSSWSNRNLSEIWDNMTWLQWDKEISNYTQIIYGLLEESQNQQEKNEQDLLAL

D
                                              (SEQ ID NO: 26)
GCCGAAAATCTGTGGGTGACTGTCTACTATGGCGTGCCTGTCTGGAAGGACGCCGAG

ACCACACTGTTCTGTGCTTCCGATGCTAAGGCATACGAAACCGAGAAACACAACGTGTGGGCAA

CCCATGCCTGCGTCCCAACAGACCCAAACCCCCAGGAAATCCACCTGGAGAATGTGACCGAGGA

GTTCAACATGTGGAAGAACAATATGGTGGAACAGATGCATGAGGACATCATTTCCCTGTGGGAT

CAGTCTCTGAAGCCTTGCGTGAAACTGACCCCACTGTGCGTGACACTGCAGTGTACAAACGTCA

CTAACAATATCACCGACGATATGCGGGGCGAACTGAAGAATTGTTCTTTCAACATGACTACCGA

GCTGAGGGACAAGAAACAGAAAGTGTACAGTCTGTTTTATCGCCTGGATGTGGTCCAGATCAAT

GAAAACCAGGGGAATCGAAGTAACAATTCAAACAAGGAGTACCGGCTGATTAATTGCAACACCA

GTGCCATCACACAGGCTTGTCCAAAAGTGTCATTCGAGCCTATCCCAATTCATTATTGCGCCCC

CGCTGGCTTCGCCATCCTGAAGTGTAAAGATAAGAAGTTCAACGGCACCGGGCCATGCCCTTCA

GTGAGCACTGTCCAGTGTACCCACGGAATTAAGCCTGTGGTCTCCACACAGCTGCTGCTGAATG

GCTCTCTGGCTGAGGAAGAAGTGATCATTAGGTCTGAGAACATCACTAACAATGCAAAGAATAT

TCTGGTGCAGCTGAACACCCCCGTCCAGATCAATTGCACTCGCCCTAACAATAACACCGTGAAA

TCTATCCGAATTGGACCCGGCCAGGCTTTTTATTACACCGGCGACATCATTGGCGACATCAGAC

AGGCACACTGCAATGTGAGCAAGGCCACATGGAACGAGACTCTGGGGAAGGTGGTCAAACAGCT

GCGCAAACATTTCGGAAATAACACAATCATTCGATTTGCACAGAGCAGCGGAGGGGACCTGGAA

GTGACAACTCACAGCTTCAATTGCGGAGGCGAGTTCTTTTACTGTAACACTAGTGGCCTGTTTA

ATTCAACTTGGATCAGCAACACCTCCGTGCAGGGCAGCAACAGCACCGGCTCTAACGATAGTAT

CACACTGCCATGTCGGATTAAGCAGATCATTAACATGTGGCAGAGAATCGGGCAGGCCATGTAT

GCACCCCCTATCCAGGGAGTGATTCGATGCGTGAGCAATATCACAGGCCTGATTCTGACTAGAG

ACGGGGGATCAACAAACAGCACCACAGAGACTTTCCGGCCCGGCGGAGGAGACATGCGAGATAA

CTGGAGATCCGAACTGTACAAGTATAAAGTGGTCAAGATCGAGCCACTGGGCGTGGCTCCCACC

AGATGCAAACGAAGAGTGGTCGGGAGGCGCCGACGGAGAAGGGCTGTGGGGATTGGAGCAGTCA

GCCTGGGCTTTCTGGGGGCCGCTGGATCTACAATGGGGGCAGCCAGTATGACTCTGACCGTGCA
```

-continued

```
GGCCAGGAATCTGCTGTCAGGAATCGTGCAGCAGCAGAGCAACCTGCTGAGGGCTCCCGAACCC

CAGCAGCACCTGCTGAAGGACACCCACTGGGGCATCAAGCAGCTGCAGGCAAGAGTGCTGGCCG

TCGAGCATTACCTGAGGGATCAGCAGCTGCTGGGCATCTGGGGATGCAGCGGAAAGCTGATTTG

CTGTACAAATGTGCCTTGGAACTCTAGTTGGAGCAATCGCAACCTGTCCGAAATCTGGGACAAT

ATGACATGGCTGCAGTGGGATAAGGAGATTAGCAACTACACTCAGATCATCTACGGCCTGCTGG

AAGAGTCCCAGAATCAGCAGGAGAAGAACGAGCAGGACCTGCTGGCCCTGGAT
```

BG505_SOSIP_D664_MD16_mC stabilizes the V3 loop (SEQ ID NO: 27)
```
AENLWVTVYYGVPVWKDAETTLFCASDAKAYETEKHNVWATHACVPTDPNPQEIHLE

NVTEEFNMWKNNMVEQMHTDIISLWDQSLKPCVKLTPLCVTLQCTNVTNNITDDMRGELKNCSF

NMTTELRDKKQKVYSLFYRLDVVQINENQGNRSNNSNKEYRLINCNTSAITQACPKVSFEPIPI

HYCAPAGWAILKCKDKKFNGTGPCPSVSTVQCTHGIKPVVSTQLLLNGSLAEEEVMIRSENITN

NAKNILVQFNTPVQINCTRPNNNTVKSIRIGPGQAFYYTGDIIGDIRQAHCNVSKATWNETLGK

VVKQLRKHFGNNTIIRFANSSGGDLEVTTHSFNCGGEFFYCNTSGLFNSTWISNTSVQGSNSTG

SNDSITLPCRIKQIINMWQRIGQAMYAPPIQGVIRCVSNITGLILTRDGGSTNSTTETFRPGGG

DMRDNWRSELYKYKVVKIEPLGVAPTRCKRRVVGRRRRRRAVGIGAVFLGFLGAAGSTMGAASM

TLTVQARNLLSGIVQQQSNLLRAPEAQQHLLKDTVWGIKQLQARVLAVERYLRDQQLLGIWGCS

GKLICCTNVPWNSSWSNRNLSEIWDNMTWLQWDKEISNYTQIIYGLLEESQNQQEKNEQDLLAL

D
```

(SEQ ID NO: 28)
```
GCTGAAAACCTGTGGGTCACTGTCTACTACGGCGTGCCTGTCTGGAAGGATGCTGAA

ACTACTCTGTTCTGTGCCTCTGATGCTAAAGCCTACGAAACCGAGAAGCACAATGTGTGGGCCA

CACATGCTTGCGTCCCTACTGACCCAAACCCCCAGGAAATCCACCTGGAGAATGTGACAGAGGA

ATTCAACATGTGGAAAAACAATATGGTGGAGCAGATGCATACTGACATCATTTCCCTGTGGGAT

CAGTCTCTGAAGCCTTGCGTGAAACTGACACCACTGTGCGTCACTCTGCAGTGTACTAACGTGA

CCAACAATATCACCGACGATATGCGGGGCGAACTGAAGAATTGTTCTTTCAACATGACCACAGA

GCTGCGGGACAAGAAACAGAAAGTGTACAGTCTGTTTTATAGACTGGATGTGGTCCAGATCAAT

GAAAACCAGGGGAATCGAAGTAACAATTCAAACAAGGAGTACCGGCTGATCAATTGCAACACAA

GTGCAATTACTCAGGCCTGTCCAAAAGTGTCATTTGAACCTATCCCAATTCATTATTGCGCTCC

CGCAGGCTGGGCCATCCTGAAGTGTAAAGATAAGAAGTTCAACGGCACCGGGCCATGCCCTTCA

GTGAGCACCGTCCAGTGTACACACGGAATTAAGCCAGTGGTCTCCACACAGCTGCTGCTGAATG

GCTCTCTGGCTGAGGAAGAAGTGATGATCAGGAGCGAGAACATTACCAACAATGCAAAGAATAT

CCTGGTGCAGTTCAACACACCCGTCCAGATTAATTGCACCCGCCCTAACAATAACACAGTGAAA

TCTATCAGAATTGGACCCGGCCAGGCATTTTATTACACCGGCGACATCATTGGGGATATCAGAC

AGGCACACTGTAATGTGAGCAAGGCCACTTGGAACGAGACCCTGGGGAAGGTGGTCAAACAGCT

GAGAAAGCATTTCGGAAACAACACTATCATCAGGTTTGCCAATAGCTCCGGCGGGGACCTGGAA

GTGACTACCCACAGCTTCAACTGCGGAGGCGAGTTCTTTTACTGTAACACAAGTGGCCTGTTTA

ATTCAACCTGGATCAGCAACACATCCGTGCAGGGATCCAATTCTACAGGCTCTAACGATAGTAT

CACTCTGCCCTGCCGCATTAAGCAGATCATTAATATGTGGCAGCGAATCGGGCAGGCTATGTAT

GCACCCCCTATCCAGGGAGTGATTAGATGTGTCAGCAATATCACTGGCCTGATTCTGACCCGCG

ACGGGGGATCAACTAACAGCACAACTGAGACCTTCCGGCCTGGAGGAGGAGACATGAGGGATAA

CTGGCGCTCCGAACTGTACAAGTATAAAGTGGTCAAGATCGAGCCACTGGGAGTGGCACCAACC
```

-continued

AGATGCAAACGAAGAGTGGTCGGAAGGCGACGACGAAGAAGGGCAGTGGGAATTGGAGCTGTCT

TCCTGGGCTTTCTGGGGGCCGCTGGATCTACAATGGGGGCAGCCAGTATGACCCTGACAGTCCA

GGCTCGAAATCTGCTGTCAGGAATCGTGCAGCAGCAGAGCAACCTGCTGAGAGCCCCTGAAGCT

CAGCAGCATCTGCTGAAGGACACCGTGTGGGGCATCAAGCAGCTGCAGGCTAGGGTGCTGGCAG

TCGAGCGCTACCTGCGAGATCAGCAGCTGCTGGGCATCTGGGGGTGTTCCGGAAAGCTGATTTG

CTGTACCAATGTGCCATGGAACTCTAGTTGGAGCAATCGCAACCTGTCCGAAATCTGGGACAAT

ATGACTTGGCTGCAGTGGGATAAGGAGATTAGCAACTACACCCAGATCATCTACGGCCTGCTGG

AAGAGTCCCAGAATCAGCAGGAGAAGAACGAGCAGGACCTGCTGGCCCTGGAT

BG505_SOSIP_D664_split1_1_mC increases melting temp 10 C.
(SEQ ID NO: 29)
AENLWVTVYYGVPVWKDAETTLFCASDAKAYETEKHNVWATHECVPTDPNPQEIHLE

NVTEEFNMWKNNMVEQMHTDIIELWDQSLKPCVKLTPLCVTLQCTNVTNNITDDMRGELKNCSF

NMTTELRDKKQKVYSLFYRLDVVQINENQGNRSNNSNKEYRLINCNTSAITQACPKVSFEPIPI

HYCAPAGFAILKCKDKKFNGTGPCPSVSTVQCTHGIKPVVSTQLLLNGSLAEEEVMIRSENITN

NAKNILVQFNTPVQINCTRPNNNTRKSIRIGPGQAFYATGDIIGDIRQAHCNVSKATWNETLGK

VVKQLRKHFGNNTIIRFANSSGGDLEVTTHSFNCGGEFFYCNTSGLFNSTWISNTSVQGSNSTG

SNDSITLPCRIKQIINMWQRIGQAMYAPPIQGVIRCVSNITGLILTRDGGSTNSTTETFRPGGG

DMRDNWRSELYKYKVVKIEPLGVAPTRCKRRVVGRRRRRRAVGIGAVFLGFLGAAGSTMGAASM

TLTVQARNLLSGIVQQQSNLLRAPEAQQHLLKLTVWGIKQLQARVLAVERYLRDQQLLGIWGCS

GKLICCTNVPWNSSWSNRNLSEIWDNMTWLQWDKEISNYTQIIYGLLEESQNQQEKNEQDLLAL

D (SEQ ID NO: 30)
GCTGAAAACCTGTGGGTCACTGTCTACTACGGCGTGCCTGTCTGGAAGGATGCTGAA

ACTACTCTGTTCTGTGCCTCTGATGCTAAAGCCTACGAAACCGAGAAGCACAATGTGTGGGCCA

CACATGAGTGCGTCCCTACTGACCCAAACCCCCAGGAAATCCACCTGGAGAATGTGACAGAGGA

ATTCAACATGTGGAAAAACAATATGGTGGAGCAGATGCATACTGACATCATTGAGCTGTGGGAT

CAGTCTCTGAAGCCTTGCGTGAAACTGACACCACTGTGCGTCACTCTGCAGTGTACTAACGTGA

CCAACAATATCACCGACGATATGCGGGGCGAACTGAAGAATTGTTCTTTCAACATGACCACAGA

GCTGCGGGACAAGAAACAGAAAGTGTACAGTCTGTTTTATAGACTGGATGTGGTCCAGATCAAT

GAAAACCAGGGGAATCGAAGTAACAATTCAAACAAGGAGTACCGGCTGATCAATTGCAACACAA

GTGCAATTACTCAGGCCTGTCCAAAAGTGTCATTTGAACCTATCCCAATTCATTATTGCGCTCC

CGCAGGCTTCGCCATCCTGAAGTGTAAAGATAAGAAGTTCAACGGCACCGGGCCATGCCCTTCA

GTGAGCACCGTCCAGTGTACACACGGAATTAAGCCAGTGGTCTCCACACAGCTGCTGCTGAATG

GCTCTCTGGCTGAGGAAGAAGTGATGATCAGGAGCGAGAACATTACCAACAATGCAAAGAATAT

CCTGGTGCAGTTCAACACACCCGTCCAGATTAATTGCACCCGCCCTAACAATAACACACGGAAA

TCTATCAGAATTGGACCCGGCCAGGCATTTTATGCCACCGGCGACATCATTGGGGATATCAGAC

AGGCACACTGTAATGTGAGCAAGGCCACTTGGAACGAGACCCTGGGGAAGGTGGTCAAACAGCT

GAGAAAGCATTTCGGAAACAACACTATCATCAGGTTTGCCAATAGCTCCGGCGGGGACCTGGAA

GTGACTACCCACAGCTTCAACTGCGGAGGCGAGTTCTTTTACTGTAACACAAGTGGCCTGTTTA

ATTCAACCTGGATCAGCAACACATCCGTGCAGGGATCCAATTCTACAGGCTCTAACGATAGTAT

CACTCTGCCCTGCCGCATTAAGCAGATCATTAATATGTGGCAGCGAATCGGGCAGGCTATGTAT

GCACCCCCTATCCAGGGAGTGATTAGATGTGTCAGCAATATCACTGGCCTGATTCTGACCCGCG

-continued

ACGGGGGATCAACTAACAGCACAACTGAGACCTTCCGGCCTGGAGGAGGAGACATGAGGGATAA

CTGGCGCTCCGAACTGTACAAGTATAAAGTGGTCAAGATCGAGCCACTGGGAGTGGCACCAACC

AGATGCAAACGAAGAGTGGTCGGAAGGCGACGACGAAGAAGGGCAGTGGGAATTGGAGCTGTCT

TCCTGGGCTTTCTGGGGGCCGCTGGATCTACAATGGGGGCAGCCAGTATGACCCTGACAGTCCA

GGCTCGAAATCTGCTGTCAGGAATCGTGCAGCAGCAGAGCAACCTGCTGAGAGCCCCTGAAGCT

CAGCAGCATCTGCTGAAGCTGACCGTGTGGGGCATCAAGCAGCTGCAGGCTAGGGTGCTGGCAG

TCGAGCGCTACCTGCGAGATCAGCAGCTGCTGGGCATCTGGGGGTGTTCCGGAAAGCTGATTTG

CTGTACCAATGTGCCATGGAACTCTAGTTGGAGCAATCGCAACCTGTCCGAAATCTGGGACAAT

ATGACTTGGCTGCAGTGGGATAAGGAGATTAGCAACTACACCCAGATCATCTACGGCCTGCTGG

AAGAGTCCCAGAATCAGCAGGAGAAGAACGAGCAGGACCTGCTGGCCCTGGAT

BG505_SOSIP_D664_MD39C_mC highest melting temp 82.5 C.

(SEQ ID NO: 31)
AENLWVTVYYGVPVWKDAETTLFCASDAKAYETEKHNVWATHECVPTDPNPQEIHLE

NVTEEFNMWKNNMVEQMHTDIIELWDQSLKPCVKLTPLCVTLQCTNVTNNITDDMRGELKNCSF

NMTTELRDKKQKVYSLFYRLDVVQINENQGNRSNNSNKEYRLINCNTSAITQACPKVSFEPIPI

HYCAPAGFAILKCKDKKFNGTGPCPSVSTVQCTHGIKPVVSTQLLLNGSLAEEEVIIRSENITN

NAKNILVQLNTPVQINCTRPNNNTVKSIRIGPGQAFYYTGDIIGDIRQAHCNVSKATWNETLGK

VVKQLRKHFGNNTIIRFAQSSGGDLEVTTHSFNCGGEFFYCNTSGLFNSTWISNTSVQGSNSTG

SNDSITLPCRIKQIINMWQRIGQAMYAPPIQGVIRCVSNITGLILTRDGGSTNSTTETFRPGGG

DMRDNWRSELYKYKVVKIEPLGVAPTRCKRRVVGRRRRRRAVGIGAVSLGFLGAAGSTMGAASM

TLTVQARNLLSGIVQQQSNLLRAPEPQQHLLKLTVWGIKQLQARVLAVEHYLRDQQLLGIWGCS

GKLICCTNVPWNSSWSNRNLSEIWDNMTWLQWDKEISNYTQIIYGLLEESQNQQEKNEQDLLAL

D (SEQ ID NO: 32)
GCCGAGAATCTGTGGGTGACCGTGTACTATGGCGTGCCCGTGTGGAAGGACGCAGAG

ACCACACTGTTCTGCGCCAGCGATGCCAAGGCCTACGAGACAGAGAAGCACAACGTGTGGGCCA

CCCACGAGTGCGTGCCTACAGACCCAAACCCCCAGGAGATCCACCTGGAGAATGTGACCGAGGA

GTTTAACATGTGGAAGAACAATATGGTGGAGCAGATGCACACAGACATCATCGAGCTGTGGGAT

CAGTCCCTGAAGCCCTGCGTGAAGCTGACCCCTCTGTGCGTGACACTGCAGTGTACCAACGTGA

CAAACAATATCACCGACGATATGAGGGGCGAGCTGAAGAATTGTAGCTTCAACATGACCACAGA

GCTGCGGGACAAGAAGCAGAAGGTGTACTCCCTGTTTTATAGACTGGATGTGGTGCAGATCAAT

GAGAACCAGGGCAATAGGTCTAACAATAGCAACAAGGAGTACCGCCTGATCAATTGCAACACCT

CTGCCATCACACAGGCCTGTCCTAAGGTGAGCTTCGAGCCTATCCCAATCCACTATTGCGCCCC

AGCCGGCTTCGCCATCCTGAAGTGTAAGGATAAGAAGTTTAACGGCACCGGCCCATGCCCTTCC

GTGTCTACCGTGCAGTGTACACACGGCATCAAGCCTGTGGTGAGCACACAGCTGCTGCTGAATG

GCTCCCTGGCCGAGGAGGAAGTGATCATCCGGAGCGAGAACATCACCAACAATGCCAAGAATAT

CCTGGTGCAGCTGAACACACCAGTGCAGATCAATTGCACCAGGCCCAACAATAACACAGTGAAG

TCTATCCGCATCGGCCCAGGCCAGGCCTTTTACTATACCGGCGACATCATCGGCGACATCAGAC

AGGCCCACTGTAATGTGAGCAAGGCCACCTGGAACGAGACACTGGGCAAGGTGGTGAAGCAGCT

GCGGAAGCACTTCGGCAATAACACCATCATCAGATTTGCACAGAGCAGCGGAGGCGACCTGGAG

GTGACCACACACTCCTTCAATTGCGGCGGCGAGTTCTTTTACTGTAACACATCCGGCCTGTTTA

ATTCTACCTGGATCTCCAACACATCTGTGCAGGGCAGCAATTCCACCGGCAGCAACGATTCCAT

```
CACACTGCCATGCAGGATCAAGCAGATCATCAACATGTGGCAGAGGATCGGACAGGCAATGTAT
GCACCACCTATCCAGGGCGTGATCAGATGCGTGAGCAATATCACCGGCCTGATCCTGACACGCG
ACGGAGGCTCTACCAACAGCACCACAGAGACATTCAGGCCCGGCGGAGGCGACATGAGGGATAA
CTGGAGATCTGAGCTGTACAAGTATAAGGTGGTGAAGATCGAGCCTCTGGGAGTGGCACCAACC
AGGTGCAAGAGGAGAGTGGTGGGCAGGCGCCGGAGAAGGCGCGCAGTGGGCATCGGAGCCGTGA
GCCTGGGCTTTCTGGGAGCAGCAGGCAGCACAATGGGCGCAGCCAGCATGACCCTGACAGTGCA
GGCCCGGAATCTGCTGTCCGGCATCGTGCAGCAGCAGTCTAACCTGCTGAGAGCCCCAGAGCCC
CAGCAGCACCTGCTGAAGCTGACCGTGTGGGGCATCAAGCAGCTGCAGGCCAGAGTGCTGGCCG
TGGAGCACTACCTGAGAGATCAGCAGCTGCTGGGCATCTGGGGATGCTCCGGCAAGCTGATCTG
CTGTACCAATGTGCCCTGGAACTCTAGCTGGAGCAATAGAAACCTGTCCGAGATCTGGGACAAT
ATGACCTGGCTGCAGTGGGATAAGGAGATCTCCAACTACACACAGATCATCTATGGCCTGCTGG
AGGAGTCTCAGAATCAGCAGGAGAAGAACGAGCAGGACCTGCTGGCCCTGGAT
```

BG505_SOSIP_D664_MD9_mC improved yield/stability (SEQ ID NO: 33)
```
AENLWVTVYYGVPVWKDAETTLFCASDAKAYETEKHNVWATHACVPTDPNPQEIHLE
NVTEEFNMWKNNMVEQMHTDIISLWDQSLKPCVKLTPLCVTLQCTNVTNNITDDMRGELKNCSF
NMTTELRDKKQKVYSLFYRLDVVQINENQGNRSNNSNKEYRLINCNTSAITQACPKVSFEPIPI
HYCAPAGFAILKCKDKKFNGTGPCPSVSTVQCTHGIKPVVSTQLLLNGSLAEEEVMIRSENITN
NAKNILVQFNTPVQINCTRPNNNTRKSIRIGPGQAFYATGDIIGDIRQAHCNVSKATWNETLGK
VVKQLRKHFGNNTIIRFANSSGGDLEVTTHSFNCGGEFFYCNTSGLFNSTWISNTSVQGSNSTG
SNDSITLPCRIKQIINMWQRIGQAMYAPPIQGVIRCVSNITGLILTRDGGSTNSTTETFRPGGG
DMRDNWRSELYKYKVVKIEPLGVAPTRCKRRVVGRRRRRRAVGIGAVFLGFLGAAGSTMGAASM
TLTVQARNLLSGIVQQQSNLLRAPERQQHLLKDTVWGIKQLQARVLAVEHYLRDQQLLGIWGCS
GKLICCTNVPWNSSWSNRNLSEIWDNMTWLQWDKEISNYTQIIYGLLEESQNQQEKNEQDLLAL
D
```

(SEQ ID NO: 34)
```
GCTGAAAACCTGTGGGTCACTGTCTACTACGGCGTGCCTGTCTGGAAGGATGCTGAA
ACTACTCTGTTCTGTGCCTCTGATGCTAAAGCCTACGAAACCGAGAAGCACAATGTGTGGGCCA
CACATGCTTGCGTCCCTACTGACCCAAACCCCAGGAAATCCACCTGGAGAATGTGACAGAGGA
ATTCAACATGTGGAAAAACAATATGGTGGAGCAGATGCATACTGACATCATTTCCCTGTGGGAT
CAGTCTCTGAAGCCTTGCGTGAAACTGACACCACTGTGCGTCACTCTGCAGTGTACTAACGTGA
CCAACAATATCACCGACGATATGCGGGGCGAACTGAAGAATTGTTCTTTCAACATGACCACAGA
GCTGCGGGACAAGAAACAGAAAGTGTACAGTCTGTTTTATAGACTGGATGTGGTCCAGATCAAT
GAAAACCAGGGGAATCGAAGTAACAATTCAAACAAGGAGTACCGGCTGATCAATTGCAACACAA
GTGCAATTACTCAGGCCTGTCCAAAAGTGTCATTTGAACCTATCCCAATTCATTATTGCGCTCC
CGCAGGCTTCGCCATCCTGAAGTGTAAAGATAAGAAGTTCAACGGCACCGGGCCATGCCCTTCA
GTGAGCACCGTCCAGTGTACACACGGAATTAAGCCAGTGGTCTCCACACAGCTGCTGCTGAATG
GCTCTCTGGCTGAGGAAGAAGTGATGATCAGGAGCGAGAACATTACCAACAATGCAAAGAATAT
CCTGGTGCAGTTCAACACACCCGTCCAGATTAATTGCACCCGCCCTAACAATAACACACGGAAA
TCTATCAGAATTGGACCCGGCCAGGCATTTTATGCCACCGGCGACATCATTGGGGATATCAGAC
AGGCACACTGTAATGTGAGCAAGGCCACTTGGAACGAGACCCTGGGGAAGGTGGTCAAACAGCT
GAGAAAGCATTTCGGAAACAACACTATCATCAGGTTTGCCAATAGCTCCGGCGGGGACCTGGAA
```

-continued

```
GTGACTACCCACAGCTTCAACTGCGGAGGCGAGTTCTTTTACTGTAACACAAGTGGCCTGTTTA
ATTCAACCTGGATCAGCAACACATCCGTGCAGGGATCCAATTCTACAGGCTCTAACGATAGTAT
CACTCTGCCCTGCCGCATTAAGCAGATCATTAATATGTGGCAGCGAATCGGGCAGGCTATGTAT
GCACCCCCTATCCAGGGAGTGATTAGATGTGTCAGCAATATCACTGGCCTGATTCTGACCCGCG
ACGGGGATCAACTAACAGCACAACTGAGACCTTCCGGCCTGGAGGAGGAGACATGAGGGATAA
CTGGCGCTCCGAACTGTACAAGTATAAAGTGGTCAAGATCGAGCCACTGGGAGTGGCACCAACC
AGATGCAAACGAAGAGTGGTCGGAAGGCGACGACGAAGAAGGGCAGTGGGAATTGGAGCTGTCT
TCCTGGGCTTTCTGGGGGCCGCTGGATCTACAATGGGGGCAGCCAGTATGACCCTGACAGTCCA
GGCTCGAAATCTGCTGTCAGGAATCGTGCAGCAGCAGAGCAACCTGCTGAGAGCCCCTGAACGG
CAGCAGCATCTGCTGAAGGACACCGTGTGGGGCATCAAGCAGCTGCAGGCTAGGGTGCTGGCAG
TCGAGCACTACCTGCGAGATCAGCAGCTGCTGGGCATCTGGGGGTGTTCCGGAAAGCTGATTTG
CTGTACCAATGTGCCATGGAACTCTAGTTGGAGCAATCGCAACCTGTCCGAAATCTGGGACAAT
ATGACTTGGCTGCAGTGGGATAAGGAGATTAGCAACTACACCCAGATCATCTACGGCCTGCTGG
AAGAGTCCCAGAATCAGCAGGAGAAGAACGAGCAGGACCTGCTGGCCCTGGAT
```

BG505_SOSIP_D664_MD2_mC improved yield (SEQ ID NO: 35)
```
AENLWVTVYYGVPVWKDAETTLFCASDAKAYETEKHNVWATHACVPTDPNPQEIHLE
NVTEEFNMWKNNMVEQMHTDIISLWDQSLKPCVKLTPLCVTLQCTNVTNNITDDMRGELKNCSF
NMTTELRDKKQKVYSLFYRLDVVQINENQGNRSNNSNKEYRLINCNTSAITQACPKVSFEPIPI
HYCAPAGFAILKCKDKKFNGTGPCPSVSTVQCTHGIKPVVSTQLLLNGSLAEEEVMIRSENITN
NAKNILVQFNTPVQINCTRPNNNTRKSIRIGPGQAFYATGDIIGDIRQAHCNVSKATWNETLGK
VVKQLRKHFGNNTIIRFANSSGGDLEVTTHSFNCGGEFFYCNTSGLFNSTWISNTSVQGSNSTG
SNDSITLPCRIKQIINMWQRIGQAMYAPPIQGVIRCVSNITGLILTRDGGSTNSTTETFRPGGG
DMRDNWRSELYKYKVVKIEPLGVAPTRCKRRVVGRRRRRRAVGIGAVFLGFLGAAGSTMGAASM
TLTVQARNLLSGIVQQQSNLLRAPEAQQHLLKDTVWGIKQLQARVLAVERYLRDQQLLGIWGCS
GKLICCTNVPWNSSWSNRNLSEIWDNMTWLQWDKEISNYTQIIYGLLEESQNQQEKNEQDLLAL
D
```

(SEQ ID NO: 36)
```
GCTGAAAACCTGTGGGTCACTGTCTACTACGGCGTGCCTGTCTGGAAGGATGCTGAA
ACTACTCTGTTCTGTGCCTCTGATGCTAAAGCCTACGAAACCGAGAAGCACAATGTGTGGGCCA
CACATGCTTGCGTCCCTACTGACCCAAACCCCCAGGAAATCCACCTGGAGAATGTGACAGAGGA
ATTCAACATGTGGAAAAACAATATGGTGGAGCAGATGCATACTGACATCATTTCCCTGTGGGAT
CAGTCTCTGAAGCCTTGCGTGAAACTGACACCACTGTGCGTCACTCTGCAGTGTACTAACGTGA
CCAACAATATCACCGACGATATGCGGGGCGAACTGAAGAATTGTTCTTTCAACATGACCACAGA
GCTGCGGGACAAGAAACAGAAAGTGTACAGTCTGTTTTATAGACTGGATGTGGTCCAGATCAAT
GAAAACCAGGGGAATCGAAGTAACAATTCAAACAAGGAGTACCGGCTGATCAATTGCAACACAA
GTGCAATTACTCAGGCCTGTCCAAAAGTGTCATTTGAACCTATCCCAATTCATTATTGCGCTCC
CGCAGGCTTCGCCATCCTGAAGTGTAAAGATAAGAAGTTCAACGGCACCGGGCCATGCCCTTCA
GTGAGCACCGTCCAGTGTACACACGGAATTAAGCCAGTGGTCTCCACACAGCTGCTGCTGAATG
GCTCTCTGGCTGAGGAAGAAGTGATGATCAGGAGCGAGAACATTACCAACAATGCAAAGAATAT
CCTGGTGCAGTTCAACACACCCGTCCAGATTAATTGCACCCGCCCTAACAATAACACACGGAAA
TCTATCAGAATTGGACCCGGCCAGGCATTTTATGCCACCGGCGACATCATTGGGGATATCAGAC
```

-continued

AGGCACACTGTAATGTGAGCAAGGCCACTTGGAACGAGACCCTGGGGAAGGTGGTCAAACAGCT

GAGAAAGCATTTCGGAAACAACACTATCATCAGGTTTGCCAATAGCTCCGGCGGGGACCTGGAA

GTGACTACCCACAGCTTCAACTGCGGAGGCGAGTTCTTTTACTGTAACACAAGTGGCCTGTTTA

ATTCAACCTGGATCAGCAACACATCCGTGCAGGGATCCAATTCTACAGGCTCTAACGATAGTAT

CACTCTGCCCTGCCGCATTAAGCAGATCATTAATATGTGGCAGCGAATCGGGCAGGCTATGTAT

GCACCCCCTATCCAGGGAGTGATTAGATGTGTCAGCAATATCACTGGCCTGATTCTGACCCGCG

ACGGGGGATCAACTAACAGCACAACTGAGACCTTCCGGCCTGGAGGAGGAGACATGAGGGATAA

CTGGCGCTCCGAACTGTACAAGTATAAAGTGGTCAAGATCGAGCCACTGGGAGTGGCACCAACC

AGATGCAAACGAAGAGTGGTCGGAAGGCGACGACGAAGAAGGGCAGTGGGAATTGGAGCTGTCT

TCCTGGGCTTTCTGGGGGCCGCTGGATCTACAATGGGGGCAGCCAGTATGACCCTGACAGTCCA

GGCTCGAAATCTGCTGTCAGGAATCGTGCAGCAGCAGAGCAACCTGCTGAGAGCCCCTGAAGCT
CAGCAGCATCTGCTGAAGGACACCGTGTGGGGCATCAAGCAGCTGCAGGCTAGGGTGCTGGCAG
TCGAGCGCTACCTGCGAGATCAGCAGCTGCTGGGCATCTGGGGGTGTTCCGGAAAGCTGATTTG

CTGTACCAATGTGCCATGGAACTCTAGTTGGAGCAATCGCAACCTGTCCGAAATCTGGGACAAT

ATGACTTGGCTGCAGTGGGATAAGGAGATTAGCAACTACACCCAGATCATCTACGGCCTGCTGG

AAGAGTCCCAGAATCAGCAGGAGAAGAACGAGCAGGACCTGCTGGCCCTGGAT

Computational designed hydrophobic core under the variable loops V1, V2, V3. (apolarV1V2+MD39)

BG505_SOSIP_D664_olio6_mC (SEQ ID NO: 37)

AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CTNVTNNITDDMRGELKNCSFNMTTELRDKKQKVYSLFWRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVIIRSENITNN
AKNILVQLNTPVQINCTAPNNFTVKSIRIGPGQAFYYMGDIIGDIRQAHC
NVSKATWNETLGKVVKQLRKHFGNNTIIRFAQSSGGDLEVTTHSFNCGGM
FFYCNTSGLFNSTWISNTSVQGSNSTGSNDSITLPCRIKLIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVSLGFLGAAGSTM
GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALD (SEQ ID NO: 38)

GCCGAAAACCTGTGGGTGACTGTCTACTATGGCGTGCCCGTCTGGAAGGA
CGCAGAGACCACACTGTTCTGCGCTAGCGATGCTAAGGCCTACGAGACCG
AGAAACACAACGTGTGGGCAACCCATGCCTGCGTGCCTACAGACCCAAAT
CCCCAGGAAATCCACCTGGAGAACGTGACCGAGGAGTTCAACATGTGGAA
GAACAATATGGTGGAACAGATGCATGAGGACATCATTTCCCTGTGGGATC
AGTCTCTGAAGCCCTGCGTGAAACTGACCCCTCTGTGCGTCACACTGCAG
TGTACAAACGTGACTAACAATATCACCGACGATATGCGGGGCGAACTGAA

-continued

GAACTGTTCTTTCAATATGACTACCGAGCTGCGCGACAAGAAACAGAAAG
TGTACAGTCTGTTTTGGCGACTGGATGTGGTCCAGATCAACGAAAATCAG
GGGAACCGGAGTAACAACTCAAATAAGGAGTATAGACTGATCAACTGCAA
TACCAGTGCCATTACACAGGCTTGTCCTAAAGTGTCATTCGAGCCTATCC
CAATTCATTACTGCGCCCCAGCTGGCTTCGCCATCCTGAAGTGTAAAGAT
AAGAAGTTCAACGGCACCGGGCCATGCCCTTCAGTGAGCACTGTCCAGTG
TACCCACGGAATTAAGCCTGTGGTCTCCACACAGCTGCTGCTGAACGGCT
CTCTGGCTGAGGAAGAAGTGATCATTAGATCCGAGAATATCACTAACAAT
GCAAAGAACATTCTGGTGCAGCTGAATACCCCAGTCCAGATCAACTGCAC
TGCCCCCAACAATTTCACCGTGAAATCTATCCGGATTGGACCAGGCCAGG
CTTTTTACTATATGGGCGACATCATTGGGGATATTAGACAGGCACACTGT
AACGTGAGCAAGGCCACATGGAATGAAACTCTGGGGAAGGTGGTCAAACA
GCTGCGAAAACATTTCGGAAACAATACAATCATTCGATTTGCACAGAGCA
GCGGAGGGGACCTGGAGGTGACAACTCACAGCTTCAACTGCGGAGGCATG
TTCTTTTATTGTAATACTAGTGGCCTGTTTAACTCAACTTGGATCAGCAA
TACCTCCGTGCAGGGCAGCAACAGCACCGGCTCTAATGATAGTATCACAC
TGCCATGCAGAATTAAGCTGATCATTAATATGTGGCAGAGGATCGGGCAG
GCTATGTACGCACCCCCTATCCAGGGAGTGATTCGGTGCGTGAGCAACAT
CACAGGCCTGATTCTGACTAGAGACGGGGGATCAACAAATAGCACCACAG
AGACTTTCAGGCCCGGCGGAGGAGACATGCGAGATAACTGGCGATCCGAA
CTGTACAAGTATAAAGTGGTCAAGATCGAGCCTCTGGGAGTGGCACCAAC
CCGATGCAAACGAAGAGTGGTCGGGAGGCGCCGACGGAGAAGGGCTGTGG

```
GGATTGGAGCAGTCTCTCTGGGCTTTCTGGGGGCCGCTGGATCTACAATG

GGGGCAGCCAGTATGACTCTGACCGTCCAGGCAAGGAACCTGCTGTCAGG

AATCGTGCAGCAGCAGAGCAATCTGCTGCGCGCTCCAGAACCCCAGCAGC

ACCTGCTGAAGGACACCCATTGGGCATCAAGCAGCTGCAGGCAAGGGTG

CTGGCAGTCGAGCACTACCTGCGAGATCAGCAGCTGCTGGGCATCTGGGG

ATGCAGCGGAAAGCTGATTTGCTGTACAAACGTGCCCTGGAACAGCAGCT

GGAGCAACCGGAATCTGTCCGAAATCTGGGACAACATGACATGGCTGCAG

TGGGATAAGGAGATTAGCAATTACACTCAGATCATCTACGGCCTGCTGGA

AGAGTCCCAGAACCAGCAGGAGAAGAACGAGCAGGACCTGCTGGCCCTGG

AT
```

Core mutations from mammalian display data to improve apex binding built onto olio6

BG505_SOSIP_D664_MD53_mC (SEQ ID NO: 39)
AENLWVTVYYGVPVWKDAETTLFCASDAKAYETEKHNVWATHACVPTDPN

PQEIHLENVTEEFNMWKNNMVEQMHEDIISLWDQSLKPCVKLTPLCVTLQ

CTNVTNNITDDMRGELKNCSFNMTTELRDKKQKVYSLFWRLDVVQINENQ

GNRSNNSNKEYRLINCNTSAITQACPKVSFEPIPIHYCAPAGFAILKCKD

KKFNGTGPCPSVSTVQCTHGIKPVLSTQLLLNGSLAEEEVIVRSENITNN

AKNILVQLNTPVQINCTAPNNFTVKSIRIGPGQAFYYMGDIIGDIRQAHC

NVSKATWNETLGKVVKQLRKHFGNNTIIRFAQSSGGDLEVTTHSFNCGGM

FFFCNTSGLFNSTWISNTSVQGSNSTGSNDSITLPCRIKLIINMWQRIGQ

AMYAPPIQGVIRCVSNITGLILTRDGGSTNSTTETFRPGGGDMRDVWRSE

LYKYKVVKIEPLGVAPTRCKRRVVGRRRRRRAVGIGAVSLGFLGAAGSTM

GAASMTLTVQARNLLSGIVQQQSNLLRAPEPQQHLLKDTHWGIKQLQARV

LAVEHYLRDQQLLGIWGCSGKLICCTNVPWNSSWSNRNLSEIWDNMTWLQ

WDKEISNYTQIIYGLLEESQNQQEKNEQDLLALD (SEQ ID NO: 40)
```
GCCGAGAACCTGTGGGTGACCGTGTACTATGGCGTGCCCGTGTGGAAGGA

CGCAGAGACCACACTGTTTTGCGCCAGCGATGCCAAGGCCTATGAGACAG

AGAAGCACAACGTGTGGGCAACCCACGCATGCGTGCCTACAGACCCAAAT

CCCCAGGAGATCCACCTGGAGAACGTGACCGAGGAGTTCAATATGTGGAA

GAACAATATGGTGGAGCAGATGCACGAGGACATCATCTCCCTGTGGGATC

AGTCTCTGAAGCCCTGCGTGAAGCTGACCCCTCTGTGCGTGACACTGCAG

TGTACCAACGTGACAAACAATATCACCGACGATATGCGGGGCGAGCTGAA

GAACTGTTCTTTTAATATGACCACAGAGCTGAGGGACAAGAAGCAGAAGG

TGTACAGCCTGTTCTGGCGCCTGGATGTGGTGCAGATCAACGAGAATCAG

GGCAACAGGTCTAACAATAGCAATAAGGAGTATCGCCTGATCAACTGCAA

TACCTCCGCCATCACACAGGCCTGTCCTAAGGTGTCTTTTGAGCCTATCC

CAATCCACTACTGCGCCCCAGCCGGCTTTGCCATCCTGAAGTGTAAGGAT

AAGAAGTTCAACGGCACCGGCCCATGCCCTTCCGTGTCTACCGTGCAGTG

TACACACGGCATCAAGCCTGTGCTGTCTACACAGCTGCTGCTGAACGGCA
```
```
GCCTGGCCGAGGAGGAAGTGATCGTGCGGAGCGAGAATATCACCAACAAT

GCCAAGAACATCCTGGTGCAGCTGAATACACCAGTGCAGATCAACTGCAC

CGCCCCCAACAACTTCACCGTGAAGTCCATCCGGATCGGCCCAGGCCAGG

CCTTCTACTATATGGGCGACATCATCGGCGACATCAGACAGGCCCACTGT

AACGTGTCTAAGGCCACCTGGAATGAGACACTGGGCAAGGTGGTGAAGCA

GCTGAGGAAGCACTTTGGCAACAATACCATCATCAGGTTCGCACAGAGCA

GCGGAGGCGACCTGGAGGTGACCACACACTCCTTTAACTGCGGCGGCATG

TTCTTTTTCTGTAATACAAGCGGCCTGTTCAACTCCACCTGGATCTCCAA

TACATCTGTGCAGGGCAGCAACTCCACCGGCAGCAATGATTCCATCACAC

TGCCATGCCGGATCAAGCTGATCATCAATATGTGGCAGAGAATCGGCCAG

GCCATGTATGCACCACCTATCCAGGGCGTGATCAGATGCGTGAGCAACAT

CACCGGCCTGATCCTGACAAGAGACGGCGGCTCTACCAATAGCACCACAG

AGACCTTCCGGCCCGGCGGAGGCGACATGAGGGACGTGTGGAGATCCGAG

CTGTACAAGTATAAGGTGGTGAAGATCGAGCCTCTGGGAGTGGCACCAAC

CAGGTGCAAGAGGAGAGTGGTGGGCAGGCGCCGGAGAAGGCGCGCAGTGG

GCATCGGCGCCGTGTCTCTGGGCTTCCTGGGAGCAGCAGGCAGCACAATG

GGCGCAGCCTCTATGACCCTGACAGTGCAGGCCAGGAACCTGCTGAGCGG

CATCGTGCAGCAGCAGTCCAATCTGCTGCGCGCCCCAGAGCCACAGCAGC

ACCTGCTGAAGGACACCCACTGGGGCATCAAGCAGCTGCAGGCCAGAGTG

CTGGCCGTGGAGCACTACCTGAGAGATCAGCAGCTGCTGGGCATCTGGGG

ATGCTCCGGCAAGCTGATCTGCTGTACCAACGTGCCCTGGAACAGCAGCT

GGTCTAACCGGAATCTGAGCGAGATCTGGGACAACATGACCTGGCTGCAG

TGGGATAAGGAGATCAGCAATTACACACAGATCATCTATGGCCTGCTGGA

GGAGTCCCAGAACCAGCAGGAGAAGAATGAGCAGGACCTGCTGGCCCTGG

AT
```

BG505_SOSIP_D664_MD37

(SEQ ID NO: 41)
AENLWVTVYYGVPVWKDAETTLFCASDAKAYETEKHNVWATHACVPTDPN

PQEIHLENVTEEFNMWKNNMVEQMHEDIISLWDQSLKPCCKLTPLCVTLQ

CTNVTNNITDDMRGELKNCSFNMTTELRDKKQKVYSLFYRLDVVQINENQ

GNRSNNSNKEYRLINCNTSACTQACPKVSFEPIPIHYCAPAGFAILKCKD

KKFNGTGPCPSVSTVQCTHGIKPVVSTQLLLNGSLAEEEVIIRSENITNN

AKNILVQLNTPVQINCTRPNNNTRKSIRIGPGCAFYATGDIIGDIRQAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

CMYAPPIQGVIRCVSNITGLILTRDGGSTNSTTETFRPGGGDMRDNWRSE

LYKYKVVKIEPLGVAPTRCKRRVVGRRRRRRAVGIGAVSLGFLGAAGSTM

GAASMTLTVQARNLLSGIVQQQSNLLRAPEPQEHLHKDTHWGIKQLQARV

LAVEHYLRDQQLLGIWGCSGKLICCTNVPWNSSWSNRNLSEIWDNMTWLQ

WDKEISNYTQIIYGLLEESQNQQEKNEQDLLALD (mutations relative to BG505 SOSIP in bold, underline)

MD37 has two extra disulfide bonds to stabilize the V3 loop (V120C, Q315C) and to prevent CD4 induced conformational changes (I201C, A433C).

IV: Examples of Trimers with Combined Germline-Targeting Mutations and Stabilization Mutations

This construct includes germline-targeting mutations built on top of the MD39 stabilization mutations from III BG505_SOSIP_D664_MD39_9mut2A_mC (MD39 + 9MUT)

(SEQ ID NO: 42)

AENLWVTVYYGVPVWKDAETTLFCASDAKAYETEKHNVWATHACVPTDPN

PQEIHLENVTEEFNMWKNNMVEQMHEDIISLWDQSLKPCVKLTPLCVTLQ

CTNYAPFLINNMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVIIRSENITNN

AKNILVQLNTPVQINCTRPNNNTVKSIRIGPGQAFYYTGDIIGDIRMAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVSLGFLGAAGSTM
GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALD (SEQ ID NO: 43)

GCCGAGAATCTGTGGGTGACCGTGTACTATGGCGTGCCCGTGTGGAAGGA
CGCAGAGACCACACTGTTCTGCGCCAGCGATGCCAAGGCCTACGAGACAG
AGAAGCACAACGTGTGGGCAACCCACGCATGCGTGCCTACAGACCCAAAC
CCCCAGGAGATCCACCTGGAGAATGTGACCGAGGAGTTTAACATGTGGAA
GAACAATATGGTGGAGCAGATGCACGAGGACATCATCTCCCTGTGGGATC
AGTCTCTGAAGCCCTGCGTGAAGCTGACCCCTCTGTGCGTGACCCTGCAG
TGTACAAACTATGCCCCCTTCCTGATCAACAATATGAGGGGCGAGCTGAA
GAATTGTTCTTTTAACATGACCACAGAGCTGCGGGACAAGAAGCAGAAAG
TGTACAGCCTGTTCTATAGACTGGATGTGGTGCAGATCAATGAGAACCAG
GGCAATAGGTCTAACAATAGCAACAAGGAGTACCGCCTGATCAATTGCAA
CACCTCCGCCATCACACAGGCCTGTCCTAAGGTGTCTTTTGAGCCTATCC
CAATCCACTATTGCGCCCCAGCCGGCTTCGCCATCCTGAAGTGTAAGGAT
AAGAAGTTTAACGGCACCGGCCCATGCCCTTCCGTGTCTACCGTGCAGTG
TACACACGGCATCAAGCCTGTGGTGTCTACACAGCTGCTGCTGAATGGCA
GCCTGGCCGAGGAGGAAGTGATCATCCGGAGCGAGAACATCACCAACAAT
GCCAAGAATATCCTGGTGCAGCTGAACACACCAGTGCAGATCAATTGCAC
CAGGCCCAACAATAACACAGTGAAGTCCATCCGCATCGGCCCAGGCCAGG
CCTTCTACTATACCGGCGACATCATCGGCGACATCAGAATGGCCCACTGT
AACGTGAGCAAGGCCACCTGGAACGAGACACTGGGCAAGGTGGTGAAGCA
GCTGCGGAAGCACTTCGGCAATAACACCATCATCAGATTTGCACAGAGCA
GCGGAGGCGACCTGGAGGTGACCACACACTCCTTCAATTGCGGCGGCGAG

-continued

TTCTTTTACTGTAACACAAGCGGCCTGTTTAATTCCACCTGGATCTCCAA
CACATCTGTGCAGGGCAGCAATTCCACCGGCAGCAACGATTCCATCACAC
TGCCATGCAGGATCAAGCAGATCATCAACATGTGGCAGAGGATCGGACAG
GCAATGTATGCACCACCTATCCAGGGCGTGATCAGATGCGTGAGCAATAT
CACCGGCCTGATCCTGACACGCGACGGAGGCTCTACCAACAGCACCACAG
AGACATTCAGGCCCGGCGGAGGCGACATGAGGGATAACTGGAGATCCGAG
CTGTACAAGTATAAGGTGGTGAAGATCGAGCCTCTGGGAGTGGCACCAAC
CAGGTGCAAGAGGAGAGTGGTGGGCAGGCGCCGGAGAAGGCGCGCAGTGG
GCATCGGAGCCGTGTCTCTGGGCTTTCTGGGAGCAGCAGGCTCCACAATG
GGCGCAGCCTCTATGACCCTGACAGTGCAGGCCCGGAATCTGCTGAGCGG
CATCGTGCAGCAGCAGTCCAACCTGCTGAGAGCCCCAGAGCCCCAGCAGC
ACCTGCTGAAGGACACCCACTGGGGCATCAAGCAGCTGCAGGCCAGAGTG
CTGGCCGTGGAGCACTACCTGAGAGATCAGCAGCTGCTGGGCATCTGGGG
ATGCTCCGGCAAGCTGATCTGCTGTACCAATGTGCCTTGGAACTCTAGCT
GGTCTAATAGAAACCTGAGCGAGATCTGGGACAATATGACCTGGCTGCAG
TGGGATAAGGAGATCAGCAACTACACACAGATCATCTATGGCCTGCTGGA
GGAGTCCCAGAATCAGCAGGAGAAGAACGAGCAGGACCTGCTGGCCCTGG
AT

This construct includes germline-targeting mutations built on top of the MD39 stabilization mutations from III BG505_SOSIP_D664_MD39_10mut_mC (SEQ ID NO: 44)

AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CTNYAPFLINDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVIIRSENITNN
AKNILVQLNTPVQINCTRPNNNTVKSIRIGPGQAFYYFGDIIGDIRMAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVSLGFLGAAGSTM
GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALD (SEQ ID NO: 45)

GCCGAGAATCTGTGGGTGACCGTGTACTATGGCGTGCCCGTGTGGAAGGA
CGCAGAGACCACACTGTTCTGCGCCAGCGATGCCAAGGCCTACGAGACAG
AGAAGCACAACGTGTGGGCAACCCACGCATGCGTGCCTACAGACCCAAAC
CCCCAGGAGATCCACCTGGAGAATGTGACCGAGGAGTTTAACATGTGGAA
GAACAATATGGTGGAGCAGATGCACGAGGACATCATCTCCCTGTGGGATC
AGTCTCTGAAGCCCTGCGTGAAGCTGACCCCTCTGTGCGTGACCCTGCAG

TGTACAAACTATGCCCCCTTCCTGATCAACGATATGAGGGGCGAGCTGAA

GAATTGTTCTTTTAACATGACCACAGAGCTGCGGGACAAGAAGCAGAAAG

TGTACAGCCTGTTCTATAGACTGGATGTGGTGCAGATCAATGAGAACCAG

GGCAATAGGTCTAACAATAGCAACAAGGAGTACCGCCTGATCAATTGCAA

CACCTCCGCCATCACACAGGCCTGTCCTAAGGTGTCTTTTGAGCCTATCC

CAATCCACTATTGCGCCCCAGCCGGCTTCGCCATCCTGAAGTGTAAGGAT

AAGAAGTTTAACGGCACCGGCCCATGCCCTTCCGTGTCTACCGTGCAGTG

TACACACGGCATCAAGCCTGTGGTGTCTACACAGCTGCTGCTGAATGGCA

GCCTGGCCGAGGAGGAAGTGATCATCCGGAGCGAGAACATCACCAACAAT

GCCAAGAATATCCTGGTGCAGCTGAACACACCAGTGCAGATCAATTGCAC

CAGGCCCAACAATAACACAGTGAAGTCCATCCGCATCGGCCCAGGCCAGG

CCTTCTACTATTTTGGCGACATCATCGGCGACATCAGAATGGCCCACTGT

AACGTGAGCAAGGCCACCTGGAACGAGACACTGGGCAAGGTGGTGAAGCA

GCTGCGGAAGCACTTCGGCAATAACACCATCATCAGATTTGCACAGAGCA

GCGGAGGCGACCTGGAGGTGACCACACACTCCTTCAATTGCGGCGGCGAG

TTCTTTTACTGTAACAAGCGGCCTGTTTAATTCCACCTGGATCTCCAA

CACATCTGTGCAGGGCAGCAATTCCACCGGCAGCAACGATTCCATCACAC

TGCCATGCAGGATCAAGCAGATCATCAACATGTGGCAGAGGATCGGACAG

GCAATGTATGCACCACCTATCCAGGGCGTGATCAGATGCGTGAGCAATAT

CACCGGCCTGATCCTGACACGCGACGGAGGCTCTACCAACAGCACCACAG

AGACATTCAGGCCCGGCGGAGGCGACATGAGGGATAACTGGAGATCCGAG

CTGTACAAGTATAAGGTGGTGAAGATCGAGCCTCTGGGAGTGGCACCAAC

CAGGTGCAAGAGGAGAGTGGTGGGCAGGCGCCGGAGAAGGCGCGCAGTGG

GCATCGGAGCCGTGTCTCTGGGCTTTCTGGGAGCAGCAGGCTCCACAATG

GGCGCAGCCTCTATGACCCTGACAGTGCAGGCCCGGAATCTGCTGAGCGG

CATCGTGCAGCAGCAGTCCAACCTGCTGAGAGCCCCAGAGCCCCAGCAGC

ACCTGCTGAAGGACACCCACTGGGGCATCAAGCAGCTGCAGGCCAGAGTG

CTGGCCGTGGAGCACTACCTGAGAGATCAGCAGCTGCTGGGCATCTGGGG

ATGCTCCGGCAAGCTGATCTGCTGTACCAATGTGCCTTGGAACTCTAGCT

GGTCTAATAGAAACCTGAGCGAGATCTGGGACAATATGACCTGGCTGCAG

TGGGATAAGGAGATCAGCAACTACACACAGATCATCTATGGCCTGCTGGA

GGAGTCCCAGAATCAGCAGGAGAAGAACGAGCAGGACCTGCTGGCCCTGG

AT

This construct includes germline-targeting mutations built on top of the MD39 stabilization mutations from III BG505_SOSIP_D664_MD39_10mut2A_mC (SEQ ID NO: 46)

AENLWVTVYYGVPVWKDAETTLFCASDAKAYETEKHNVWATHACVPTDPN

PQEIHLENVTEEFNMWKNNMVEQMHEDIISLWDQSLKPCVKLTPLCVTLQ

CTNYAPFLINNMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVIIRSENITNN

AKNILVQLNTPVQINCTRPNNNTVKSIRIGPGQAFYYFGDIIGDIRMAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVSLGFLGAAGSTM

GAASMTLTVQARNLLSGIVQQQSNLLRAPEPQQHLLKDTHWGIKQLQARV

LAVEHYLRDQQLLGIWGCSGKLICCTNVPWNSSWSNRNLSEIWDNMTWLQ

WDKEISNYTQIIYGLLEESQNQQEKNEQDLLALD (SEQ ID NO: 47)

GCCGAGAATCTGTGGGTGACCGTGTACTATGGCGTGCCCGTGTGGAAGGA

CGCAGAGACCACACTGTTCTGCGCCAGCGATGCCAAGGCCTACGAGACAG

AGAAGCACAACGTGTGGGCAACCCACGCATGCGTGCCTACAGACCCAAAC

CCCCAGGAGATCCACCTGGAGAATGTGACCGAGGAGTTTAACATGTGGAA

GAACAATATGGTGGAGCAGATGCACGAGGACATCATCTCCCTGTGGGATC

AGTCTCTGAAGCCCTGCGTGAAGCTGACCCCTCTGTGCGTGACCCTGCAG

TGTACAAACTATGCCCCCTTCCTGATCAACAATATGAGGGGCGAGCTGAA

GAATTGTTCTTTTAACATGACCACAGAGCTGCGGGACAAGAAGCAGAAAG

TGTACAGCCTGTTCTATAGACTGGATGTGGTGCAGATCAATGAGAACCAG

GGCAATAGGTCTAACAATAGCAACAAGGAGTACCGCCTGATCAATTGCAA

CACCTCCGCCATCACACAGGCCTGTCCTAAGGTGTCTTTTGAGCCTATCC

CAATCCACTATTGCGCCCCAGCCGGCTTCGCCATCCTGAAGTGTAAGGAT

AAGAAGTTTAACGGCACCGGCCCATGCCCTTCCGTGTCTACCGTGCAGTG

TACACACGGCATCAAGCCTGTGGTGTCTACACAGCTGCTGCTGAATGGCA

GCCTGGCCGAGGAGGAAGTGATCATCCGGAGCGAGAACATCACCAACAAT

GCCAAGAATATCCTGGTGCAGCTGAACACACCAGTGCAGATCAATTGCAC

CAGGCCCAACAATAACACAGTGAAGTCCATCCGCATCGGCCCAGGCCAGG

CCTTCTACTATTTTGGCGACATCATCGGCGACATCAGAATGGCCCACTGT

AACGTGAGCAAGGCCACCTGGAACGAGACACTGGGCAAGGTGGTGAAGCA

GCTGCGGAAGCACTTCGGCAATAACACCATCATCAGATTTGCACAGAGCA

GCGGAGGCGACCTGGAGGTGACCACACACTCCTTCAATTGCGGCGGCGAG

TTCTTTTACTGTAACAAGCGGCCTGTTTAATTCCACCTGGATCTCCAA

CACATCTGTGCAGGGCAGCAATTCCACCGGCAGCAACGATTCCATCACAC

TGCCATGCAGGATCAAGCAGATCATCAACATGTGGCAGAGGATCGGACAG

GCAATGTATGCACCACCTATCCAGGGCGTGATCAGATGCGTGAGCAATAT

CACCGGCCTGATCCTGACACGCGACGGAGGCTCTACCAACAGCACCACAG

AGACATTCAGGCCCGGCGGAGGCGACATGAGGGATAACTGGAGATCCGAG

CTGTACAAGTATAAGGTGGTGAAGATCGAGCCTCTGGGAGTGGCACCAAC

CAGGTGCAAGAGGAGAGTGGTGGGCAGGCGCCGGAGAAGGCGCGCAGTGG

GCATCGGAGCCGTGTCTCTGGGCTTTCTGGGAGCAGCAGGCTCCACAATG

GGCGCAGCCTCTATGACCCTGACAGTGCAGGCCCGGAATCTGCTGAGCGG

```
CATCGTGCAGCAGCAGTCCAACCTGCTGAGAGCCCCAGAGCCCCAGCAGC

ACCTGCTGAAGGACACCCACTGGGGCATCAAGCAGCTGCAGGCCAGAGTG

CTGGCCGTGGAGCACTACCTGAGAGATCAGCAGCTGCTGGGCATCTGGGG

ATGCTCCGGCAAGCTGATCTGCTGTACCAATGTGCCTTGAACTCTAGCT

GGTCTAATAGAAACCTGAGCGAGATCTGGGACAATATGACCTGGCTGCAG

TGGGATAAGGAGATCAGCAACTACACACAGATCATCTATGGCCTGCTGGA

GGAGTCCCAGAATCAGCAGGAGAAGAACGAGCAGGACCTGCTGGCCCTGG

AT
```

This construct includes germline-targeting mutations built on top of the MD39 stabilization mutations from III BG505_SOSIP_D664_MD39_11mut2A_mC
(SEQ ID NO: 48)
```
AENLWVTVYYGVPVWKDAETTLFCASDAKAYETEKHNVWATHACVPTDPN

PQEIHLENVTEEFNMWKNNMVEQMHEDIISLWDQSLKPCVKLTPLCVTLQ

CTNYAPNLLSNMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVIIRSENITNN

AKNILVQLNTPVQINCTRPNNNTVKSIRIGPGQAFYYFGDIIGDIRMAHC

NVSKATWNETLGKVVKQLRKHFGNNTIIRFAQSSGGDLEVTTHSFNCGGE

FFYCNTSGLFNSTWISNTSVQGSNSTGSNDSIVLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVSLGFLGAAGSTM

GAASMTLTVQARNLLSGIVQQQSNLLRAPEPQQHLLKDTHWGIKQLQARV

LAVEHYLRDQQLLGIWGCSGKLICCTNVPWNSSWSNRNLSEIWDNMTWLQ

WDKEISNYTQIIYGLLEESQNQQEKNEQDLLALD
```

(SEQ ID NO: 49)
```
GCCGAAAACCTGTGGGTGACTGTCTATTATGGCGTGCCCGTGTGGAAAGA

TGCTGAAACTACTCTGTTCTGTGCAAGCGATGCTAAGGCCTACGAGACAG

AGAAGCACAACGTGTGGGCAACCCACGCATGCGTGCCTACAGACCCAAAT

CCCCAGGAGATCCACCTGGAGAACGTGACAGAGGAGTTCAATATGTGGAA

GAACAATATGGTGGAGCAGATGCACGAGGACATCATCTCCCTGTGGGATC

AGTCTCTGAAGCCCTGCGTGAAGCTGACCCCTCTGTGCGTGACCCTGCAG

TGTACAAATTATGCCCCAAACCTGCTGTCCAATATGAGGGGCGAGCTGAA

GAACTGTTCTTTCAATATGACCACAGAGCTGCGGGACAAGAAGCAGAAGG

TGTACAGCCTGTTTTATAGACTGGATGTGGTGCAGATCAATGAGAACCAG

GGCAACAGGTCTAACAATAGCAATAAGGAGTACCGCCTGATCAATTGCAA

CACCAGCGCCATCACACAGGCCTGTCCTAAGGTGTCCTTTGAGCCTATCC

CAATCCACTATTGCGCCCCAGCCGGCTTCGCCATCCTGAAGTGTAAGGAT

AAGAAGTTTAACGGCACCGGCCCATGCCCTTCCGTGTCTACAGTGCAGTG

TACACACGGCATCAAGCCAGTGGTGTCTACACAGCTGCTGCTGAACGGCA

GCCTGGCCGAGGAGGAAGTGATCATCCGGAGCGAGAATATCACCAACAAT

GCCAAGAACATCCTGGTGCAGCTGAATACACCAGTGCAGATCAACTGCAC

CAGGCCCAACAATAACACAGTGAAGTCTATCCGGCATCGGCCCCGGCCAGG

CCTTCTACTATTTTGGCGACATCATCGGCGATATCAGAATGGCCCACTGT

AACGTGAGCAAGGCCACCTGGAATGAGACACTGGGCAAGGTGGTGAAGCA

GCTGCGGAAGCACTTCGGCAATAACACCATCATCAGATTTGCACAGTCCT

CCGGCGGCGACCTGGAGGTGACCACACACTCCTTCAACTGCGGCGGCGAG

TTCTTTTACTGTAATACCAGCGGCCTGTTTAACTCCACCTGGATCTCCAA

TACATCTGTGCAGGGCAGCAACTCCACAGGCAGCAATGATTCCATCGTGC

TGCCCTGCAGGATCAAGCAGATCATCAACATGTGGCAGCGCATCGGCCAG

GCCATGTATGCCCCTCCCATCCAGGGCGTGATCAGATGCGTGAGCAACAT

TACCGGCCTGATCCTGACAAGAGATGGCGGATCTACCAATAGCACAACCG

AGACATTCAGGCCCGGCGGCGGCGACATGAGAGATAACTGGAGATCTGAG

CTGTACAAGTATAAGGTGGTGAAGATTGAGCCTCTGGGAGTGGCACCAAC

AAGATGCAAGAGAAGAGTGGTGGGCAGGCGCCGGAGAAGGCGCGCAGTGG

GCATTGGAGCCGTGTCCCTGGGCTTTCTGGGAGCAGCAGGATCCACAATG

GGAGCAGCCTCTATGACCCTGACAGTGCAGGCCCGGAACCTGCTGAGCGG

CATCGTGCAGCAGCAGTCCAATCTGCTGAGAGCCCCAGAGCCCCAGCAGC

ACCTGCTGAAGGACACCCACTGGGGCATCAAGCAGCTGCAGGCACGGGTG

CTGGCAGTGGAGCACTACCTGAGAGATCAGCAGCTGCTGGGCATCTGGGG

CTGTAGCGGCAAGCTGATCTGCTGTACCAACGTGCCCTGGAATTCTAGCT

GGTCTAATAGAAACCTGAGCGAGATCTGGGACAACATGACCTGGCTGCAG

TGGGATAAGGAGATCTCCAATTACACACAGATCATCTATGGCCTGCTGGA

GGAATCACAGAATCAGCAGGAAAAGAACGAACAGGATCTGCTGGCACTGG

AT
```

V: Trimers with Modified Surfaces or of Different Strains than BG505, that can be Employed in Strategic Boosting Regimens

Variable loop cocktails. Shown on MD39 background

BG505_SOSIP_MD39_VLC1-03
(SEQ ID NO: 50)
```
AENLWVTVYYGVPVWKDAETTLFCASDAKAYETEKHNVWATHACVPTDPN

PQEIHLENVTEEFNMWKNNMVEQMHEDIISLWDQSLKPCVKLTPLCVTLQ

CTDWDNATLANMTGEIKNCSFNMTTELRDKKQKVYSLFYELDIIPIENEY

ISNNNTSNTSYRLINCNTSAITQACPKVSFEPIPIHYCAPAGFAILKCKD

KKFNGTGPCPSVSTVQCTHGIKPVVSTQLLLNGSLAEEEVIIRSENITNN

AKNILVQLNTPVQINCTRPNNNTVKSIRIGPGQAFYYTGDIIGDIRQAHC

NVSATQWEQTLKGIAAKLLEHFGNNTIIRFAQSSGGDLEVTTHSFNCGGE

FFYCNTSGLFNGSSWNLNKTKENTTNLENGTTTLPCRIKQIINMWQRIGQ

AMYAPPIQGVIRCVSNITGLILTRDGGNKSAGIETFRPGGGDMRDNWRSE

LYKYKVVKIEPLGVAPTRCKRRVVGRRRRRRAVGIGAVSLGFLGAAGSTM
```

GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALD (SEQ ID NO: 51)
GCCGAGAACCTGTGGGTGACCGTGTACTATGGCGTGCCCGTGTGGAAGGA
CGCAGAGACCACACTGTTCTGCGCCTCCGATGCCAAGGCCTACGAGACAG
AGAAGCACAACGTGTGGGCAACCCACGCATGCGTGCCTACAGACCCAAAT
CCCCAGGAGATCCACCTGGAGAATGTGACAGAGGAGTTTAACATGTGGAA
GAACAATATGGTGGAGCAGATGCACGAGGACATCATCTCCCTGTGGGATC
AGTCTCTGAAGCCCTGCGTGAAGCTGACCCCTCTGTGCGTGACCCTGCAG
TGTACAGACTGGGATAATGCCACCCTGGCCAACATGACAGGCGAGATCAA
GAATTGTTCCTTCAACATGACCACAGAGCTGCGGGACAAGAAGCAGAAGG
TGTACTCTCTGTTTTATGAGCTGGACATCATCCCCATCGAGAACGAGTAC
ATCAGCAACAATAACACCTCTAATACAAGCTATAGACTGATCAACTGCAA
TACCTCTGCCATCACACAGGCCTGTCCTAAGGTGAGCTTCGAGCCTATCC
CAATCCACTATTGCGCCCCAGCCGGCTTCGCCATCCTGAAGTGTAAGGAT
AAGAAGTTTAACGGCACCGGCCCATGCCCTAGCGTGTCCACCGTGCAGTG
TACACACGGCATCAAGCCTGTGGTGAGCACACAGCTGCTGCTGAACGGCT
CCCTGGCCGAGGAGGAAGTGATCATCAGGAGCGAGAATATCACCAATAAC
GCCAAGAATATCCTGGTGCAGCTGAACACACCAGTGCAGATCAATTGCAC
CCGGCCCAATAACAATACAGTGAAGTCCATCAGAATCGGCCCAGGCCAGG
CCTTTTACTATACCGGCGACATCATCGGCGACATCAGGCAGGCCCACTGT
AACGTGTCTGCCACCCAGTGGGAGCAGACACTGAAGGGCATCGCCGCCAA
GCTGCTGGAGCACTTCGGCAACAATACCATCATCAGGTTTGCACAGAGCA
GCGGAGGCGACCTGGAGGTGACCACACACTCCTTCAATTGCGGCGGCGAG
TTCTTTTACTGTAACACCTCTGGCCTGTTTAATGGCTCTAGCTGGAACCT
GAATAAGACAAAGGAGAACACCACAAATCTGGAGAACGGCACCATCACAC
TGCCATGCAGGATCAAGCAGATCATCAACATGTGGCAGAGGATCGGACAG
GCAATGTATGCACCACCTATCCAGGGCGTGATCAGATGCGTGAGCAACAT
CACCGGCCTGATCCTGACAAGAGATGGCGGCAATAAGAGCGCCGGCATCG
AGACCTTCCGGCCCGGCGGAGGCGACATGAGGGATAACTGGAGATCCGAG
CTGTACAAGTATAAGGTGGTGAAGATCGAGCCTCTGGGCGTGGCCCCAAC
AAGATGCAAGAGGAGAGTGGTGGGCAGGCGCCGGAGAAGGCGCGCAGTGG
GCATCGGAGCCGTGAGCCTGGGCTTTCTGGGAGCAGCAGGCAGCACAATG
GGCGCAGCCAGCATGACCCTGACAGTGCAGGCCAGGAACCTGCTGTCCGG
CATCGTGCAGCAGCAGTCTAATCTGCTGCGCGCCCCAGAGCCACAGCAGC
ACCTGCTGAAGGACACCCACTGGGGCATCAAGCAGCTGCAGGCCAGGGTG
CTGGCAGTGGAGCACTACCTGAGGGATCAGCAGCTGCTGGGCATCTGGGG
ATGCAGCGGCAAGCTGATCTGCTGTACCAATGTGCCTTGGAACTCCTCTT
GGAGCAACCGGAATCTGTCCGAGATCTGGGACAACATGACCTGGCTGCAG
TGGGATAAGGAGATCAGCAATTACACACAGATCATCTATGGCCTGCTGGA

GGAGTCCCAGAATCAGCAGGAGAAGAACGAGCAGGACCTGCTGGCCCTGG
AT

BG505_SOSIP_MD39_VLC2-04

(SEQ ID NO: 52)
AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CSDYEGNTTRQNITMKEEKGEIKNCSFNMTTELRDKKQKVYSLFY**KLDIT
PIEEDNNSNNSSSANSSNSNANYTN**YRLINCNTSAITQACPKVSFEPIPI
HYCAPAGFAILKCKDKKFNGTGPCPSVSTVQCTHGIKPVVSTQLLLNGSL
AEEEVIIRSENITNNAKNILVQLNTPVQINCTRPNNNTVKSIRIGPGQAF
YYTGDIIGDIRQAHCNVSGTKWKNTLKQIVKKLGDHFGNNTIIRFAQSSG
GDLEVTTHSFNCGGEFFYCNTSGLFNSTW**NRTNGTWNDVEGLNYTNGNDT
ITLPCRIKQIINMWQRIGQAMYAPPIQGVIRCVSNITGLILTRDGG**NDTD
KN**ETFRPGGGDMRDNWRSELYKYKVVKIEPLGVAPTRCKRRVVGRRRRRR
AVGIGAVSLGFLGAAGSTMGAASMTLTVQARNLLSGIVQQQSNLLRAPEP
QQHLLKDTHWGIKQLQARVLAVEHYLRDQQLLGIWGCSGKLICCTNVPWN
SSWSNRNLSEIWDNMTWLQWDKEISNYTQIIYGLLEESQNQQEKNEQDLL
ALD (SEQ ID NO: 53)
GCCGAGAACCTGTGGGTGACCGTGTACTATGGCGTGCCCGTGTGGAAGGA
CGCAGAGACCACACTGTTCTGCGCCTCTGATGCCAAGGCCTACGAGACAG
AGAAGCACAACGTGTGGGCAACCCACGCATGCGTGCCTACAGACCCAAAC
CCCCAGGAGATCCACCTGGAGAACGTGACCGAGGAGTTTAATATGTGGAA
GAACAATATGGTGGAGCAGATGCACGAGGACATCATCTCTCTGTGGGATC
AGAGCCTGAAGCCCTGCGTGAAGCTGACCCCTCTGTGCGTGACACTGCAG
TGTAGCGACTATGAGGGCAACACCACACGGCAGAATATCACCATGAAGGA
GGAGAAGGGCGAGATCAAGAACTGTTCTTTCAATATGACCACAGAGCTGA
GAGATAAGAAGCAGAAGGTGTACAGCCTGTTTTATAAGCTGGACATCACC
CCCATCGAGGAGGATAACAATTCCAACAATAGCTCCTCTGCCAATAGCTC
CAATTCTAACGCCAATTACACAAAACTATAGGCTGATCAACTGCAATACCT
CTGCCATCACACAGGCCTGTCCTAAGGTGAGCTTCGAGCCTATCCCAATC
CACTACTGCGCCCCAGCCGGCTTCGCCATCCTGAAGTGTAAGGATAAGAA
GTTTAACGGCACCGGCCCATGCCCTAGCGTGTCCACCGTGCAGTGTACAC
ACGGCATCAAGCCTGTGGTGAGCACACAGCTGCTGCTGAATGGCTCCCTG
GCCGAGGAGGAAGTGATCATCCGCTCCGAGAACATCACCAACAATGCCAA
GAACATCCTGGTGCAGCTGAATACACCAGTGCAGATCAACTGCACCCGGC
CCAACAATAACACAGTGAAGTCCATCAGAATCGGCCCAGGCCAGGCCTTT
TACTATACCGGCGACATCATCGGCGACATCCGGCAGGCCCACTGTAACGT
GAGCGGCACCAAGTGGAAGAACACACTGAAGCAGATCGTGAAGAAGCTGG
GCGACCACTTCGGCAATAACACCATCATCAGATTTGCCCAGTCTAGCGGC
GGCGATCTGGAGGTGACCACACACAGCTTCAATTGCGGCGGCGAGTTCTT
TTACTGTAATACCTCCGGCCTGTTTAACTCTACATGGAACCGGACCAATG

```
GCACATGGAATGACGTGGAGGGCCTGAACTATACCAACGGCAATGATACC
ATCACACTGCCATGCAGGATCAAGCAGATCATCAATATGTGGCAGAGGAT
CGGACAGGCAATGTACGCACCACCTATCCAGGGCGTGATCAGATGCGTGA
GCAACATCACCGGCCTGATCCTGACAAGAGACGGCGGCAACGACACCGAT
AAGAATGAGACATTCAGGCCCGGCGGAGGCGACATGAGGGATAACTGGAG
ATCCGAGCTGTACAAGTATAAGGTGGTGAAGATCGAGCCTCTGGGAGTGG
CACCAACCAGGTGCAAGAGGAGAGTGGTGGGCAGGCGCCGGAGAAGGCGC
GCAGTGGGCATCGGAGCCGTGTCCCTGGGCTTTCTGGGAGCAGCAGGCTC
TACAATGGGCGCAGCCAGCATGACCCTGACAGTGCAGGCCAGGAATCTGC
TGTCCGGCATCGTGCAGCAGCAGTCTAACCTGCTGCGCGCCCCAGAGCCA
CAGCAGCACCTGCTGAAGGACACCCACTGGGGCATCAAGCAGCTGCAGGC
CAGGGTGCTGGCAGTGGAGCACTATCTGCGCGATCAGCAGCTGCTGGGCA
TCTGGGGATGCAGCGGCAAGCTGATCTGCTGTACAAACGTGCCCTGGAAC
AGCAGCTGGAGCAACAGGAATCTGTCCAGAGATCTGGGACAATATGACCTG
GCTGCAGTGGGATAAGGAGATCAGCAACTACACACAGATCATCTATGGCC
TGCTGGAGGAGTCCCAGAACCAGCAGGAGAAGAATGAGCAGGACCTGCTG
GCCCTGGAT
```

BG505_SOSIP_MD39_VLC2-08

(SEQ ID NO: 54)
AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CVTLKNCSNSNCSISRNISIEMDGEIKNCSFNMTTELRDKKQKVYSLFYR
LDIVPIESSNNSQLSNNSQVSNNSQSSNYSQYRLINCNTSAITQACPKVS
FEPIPIHYCAPAGFAILKCKDKKFNGTGPCPSVSTVQCTHGIKPVVSTQL
LLNGSLAEEEVIIRSENITNNAKNILVQLNTPVQINCTRPNNNTVKSIRI
GPGQAFYYTGDIIGDIRQAHCNVSKKDWEKTLQQVATKLGQHFGNNTIIR
FAQSSGGDLEVTTHSFNCGGEFFYCNTSGLFNSTWI**RNSSNSTWNSSASN
STELNSN**ITLPCRIKQIINMWQRIGQAMYAPPIQGVIRCVSNITGLILTR
DGGHETENKTETFRPGGGDMRDNWRSELYKYKVVKIEPLGVAPTRCKRRV
VGRRRRRRAVGIGAVSLGFLGAAGSTMGAASMTLTVQARNLLSGIVQQQS
NLLRAPEPQQHLLKDTHWGIKQLQARVLAVEHYLRDQQLLGIWGCSGKLI
CCTNVPWNSSWSNRNLSEIWDNMTWLQWDKEISNYTQIIYGLLEESQNQQ
EKNEQDLLALD (SEQ ID NO: 55)
```
GCCGAGAACCTGTGGGTGACAGTGTACTATGGCGTGCCCGTGTGGAAGGA
CGCAGAGACCACACTGTTCTGCGCCAGCGATGCCAAGGCCTACGAGACCG
AGAAGCACAACGTGTGGGCAACACACGCATGCGTGCCTACCGACCCAAAT
CCCCAGGAGATCCACCTGGAGAATGTGACCGAGGAGTTTAACATGTGGAA
GAACAATATGGTGGAGCAGATGCACGAGGACATCATCTCCCTGTGGGATC
AGTCTCTGAAGCCCTGCGTGAAGCTGACCCCTCTGTGCGTGACACTGCAG
TGCGTGACCCTGAAGAACTGCAGCAATTCCAACTGTTCTATCAGCAGGAA
TATCTCCATCGAGATGGATGGCGAGATCAAGAATTGTTCTTTCAACATGA
```

```
CCACAGAGCTGCGGGACAAGAAGCAGAAAGTGTACAGCCTGTTCTACCGG
CTGGACATCGTGCCCATCGAGAGCAGCAACAATTCTCAGCTGAGCAACAA
TTCCCAGGTGTCTAACAATAGCCAGTCTAGCAACTACTCCCAGTATCGCC
TGATCAATTGCAACACCTCTGCCATCACACAGGCCTGTCCTAAGGTGAGC
TTCGAGCCTATCCCAATCCACTATTGCGCCCCAGCCGGCTTCGCCATCCT
GAAGTGTAAGGACAAGAAGTTTAACGGCACAGGCCCCTGCCCTTCCGTGT
CTACCGTGCAGTGTACACACGGCATCAAGCCTGTGGTGTCTACCCAGCTG
CTGCTGAACGGCAGCCTGGCAGAGGAGGAAGTGATCATCCGGAGCGAGAA
TATCACAAACAATGCCAAGAATATCCTGGTGCAGCTGAACACCCCAGTGC
AGATCAATTGCACACGGCCCAACAATAACACCGTGAAGTCCATCAGAATC
GGCCCAGGCCAGGCCTTTTACTATACAGGCGACATCATCGGCGACATCCG
GCAGGCCCACTGTAACGTGTCTAAGAAGGACTGGGAGAAGACACTGCAGC
AGGTGGCCACCAAGCTGGGCCAGCACTTCGGCAATAACACCATCATCAGA
TTTGCCCAGTCCTCTGGCGGCGATCTGGAGGTGACCACACACTCCTTCAA
TTGCGGCGGCGAGTTCTTTTACTGTAACACAAGCGGCCTGTTTAATTCCA
CCTGGATCAGAAATAGCTCCAACTCTACCTGGAACAGCAGCGCCAGCAAC
TCCACAGAGCTGAATAGCAACATCACCCTGCCATGCAGGATCAAGCAGAT
CATCAACATGTGGCAGAGGATCGGACAGGCAATGTATGCACCACCTATCC
AGGGCGTGATCAGATGCGTGAGCAATATCACAGGCCTGATCCTGACCCGC
GATGGAGGACACGAGACCGAGAACAAGACCGAGACATTCAGGCCCGGCGG
AGGCGACATGAGGGATAATTGGAGATCCGAGCTGTACAAGTATAAGGTGG
TGAAGATCGAGCCTCTGGGAGTGGCACCAACCAAGGTGCAAGAGGAGAGTG
GTGGGCAGGCGCCGGAGAAGGCGCGCAGTGGGCATCGGAGCCGTGAGCCT
GGGCTTTCTGGGAGCAGCAGGCAGCACAATGGGCGCAGCCTCTATGACCC
TGACAGTGCAGGCCCGGAACCTGCTGAGCGGCATCGTGCAGCAGCAGTCC
AATCTGCTGAGAGCCCCAGAGCCCCAGCAGCACCTGCTGAAGGACACACA
CTGGGGCATCAAGCAGCTGCAGGCCAGGGTGCTGGCAGTGGAGCACTACC
TGAGGGATCAGCAGCTGCTGGGCATCTGGGGATGCTCCGGCAAGCTGATC
TGCTGTACCAATGTGCCTTGGAACTCCTCTTGGTCTAATCGGAACCTGAG
CGAGATCTGGGACAACATGACATGGCTGCAGTGGGATAAGGAGATCAGCA
ATTACACCCAGATCATCTATGGCCTGCTGGAGGAGTCCCAGAATCAGCAG
GAGAAGAACGAGCAGGACCTGCTGGCCCTGGAT
```

BG505_SOSIP_MD39_VLC3-13

(SEQ ID NO: 56)
AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CTNAALTNVTITNGPNITEEIRNCSFNMTTELRDKKQKVYSLFY**KLDLVQ
INGSGGE**YRLINCNTSAITQACPKVSFEPIPIHYCAPAGFAILKCKDKKF
NGTGPCPSVSTVQCTHGIKPVVSTQLLLNGSLAEEEVIIRSENITNNAKN
ILVQLNTPVQINCTRPNNNTVKSIRIGPGQAFYYTGDIIGDIRQAHCNVS
GTKWNETLKQVAGKLRKHFGNNTIIRFAQSSGGDLEVTTHSFNCGGEFFY

CNTSGLFNSTWPENGTMEGSNGTITLPCRIKQIINMWQRIGQAMYAPPIQ
GVIRCVSNITGLILTRDGGNSTTDTETFRPGGGDMRDNWRSELYKYKVVK
IEPLGVAPTRCKRRVVGRRRRRRAVGIGAVSLGFLGAAGSTMGAASMTLT
VQARNLLSGIVQQQSNLLRAPEPQQHLLKDTHWGIKQLQARVLAVEHYLR
DQQLLGIWGCSGKLICCTNVPWNSSWSNRNLSEIWDNMTWLQWDKEISNY
TQIIYGLLEESQNQQEKNEQDLLALD (SEQ ID NO: 57)
GCCGAGAACCTGTGGGTGACCGTGTACTATGGCGTGCCAGTGTGGAAGGA
CGCCGAGACCACACTGTTCTGCGCCTCTGATGCCAAGGCCTACGAGACAG
AGAAGCACAACGTGTGGGCAACCCACGCATGCGTGCCAACAGACCCAAAC
CCCCAGGAGATCCACCTGGAGAATGTGACCGAGGAGTTTAACATGTGGAA
GAACAATATGGTGGAGCAGATGCACGAGGACATCATCAGCCTGTGGGATC
AGTCCCTGAAGCCCTGCGTGAAGCTGACCCCTCTGTGCGTGACCCTGCAG
TGTACAAATGCCGCCCTGACCAACGTGACCATCACAAATGGCCCCAACAT
CACAGAGGAGATCAGGAATTGTTCCTTCAACATGACCACAGAGCTGCGCG
ACAAGAAGCAGAAGGTGTACTCTCTGTTTTATAAGCTGGATCTGGTGCAG
ATCAATGGCAGCGGCGGCGAGTACCGGCTGATCAATTGCAACACCAGCGC
CATCACACAGGCCTGTCCTAAGGTGTCCTTCGAGCCTATCCCAATCCACT
ATTGCGCCCCAGCCGGCTTCGCCATCCTGAAGTGTAAGGACAAGAAGTTT
AACGGCACCGGCCCATGCCCTTCCGTGTCTACCGTGCAGTGTACACACGG
CATCAAGCCTGTGGTGTCCACACAGCTGCTGCTGAATGGCTCTCTGGCCG
AGGAGGAAGTGATCATCAGGAGCGAGAACATCACCAACAATGCCAAGAAT
ATCCTGGTGCAGCTGAACACACCAGTGCAGATCAATTGCACCCGGCCCAA
CAATAACACAGTGAAGTCTATCAGAATCGGCCCAGGCCAGGCCTTTTACT
ATACCGGCGACATCATCGGCGACATCCGCCAGGCCCACTGTAATGTGAGC
GGCACCAAGTGGAACGAGACACTGAAGCAGGTGGCCGGCAAGCTGAGGAA
GCACTTCGGCAATAACACCATCATCCGCTTTGCACAGAGCAGCGGAGGCG
ATCTGGAGGTGACCACACACTCCTTCAATTGCGGCGGCGAGTTCTTTTAC
TGTAACACATCTGGCCTGTTTAATAGCACCTGGCCCGAGAACGGCACAAT
GGAGGGCTCTAATGGCACCATCACACTGCCTTGCCGGATCAAGCAGATCA
TCAACATGTGGCAGAGAATCGGCCAGGCCATGTATGCACCACCTATCCAG
GGCGTGATCAGATGCGTGAGCAATATCACCGGCCTGATCCTGACAAGAGA
CGGCGGCAACTCCACCACAGATACCGAGACATTCCGGCCCGGCGGAGGCG
ACATGAGGGATAACTGGAGAAGCGAGCTGTACAAGTATAAGGTGGTGAAG
ATCGAGCCTCTGGGCGTGGCCCCAACCAGATGCAAGAGGAGAGTGGTGGG
CAGGCGCCGGAGAAGGCGCGCAGTGGGCATCGGAGCCGTGTCCCTGGGCT
TTCTGGGAGCAGCAGGCAGCACAATGGGCGCAGCCTCCATGACCCTGACA
GTGCAGGCCAGGAATCTGCTGTCTGGCATCGTGCAGCAGCAGAGCAACCT
GCTGCGCGCCCCAGAGCCACAGCAGCACCTGCTGAAGGACACCCACTGGG
GCATCAAGCAGCTGCAGGCCAGGGTGCTGGCAGTGGAGCACTACCTGAGG
GATCAGCAGCTGCTGGGCATCTGGGGATGCTCCGGCAAGCTGATCTGCTG

TACCAATGTGCCTTGGAACTCTAGCTGGTCCAATAGGAACCTGTCTGAGA
TCTGGGACAATATGACCTGGCTGCAGTGGGATAAGGAGATCTCCAACTAC
ACACAGATCATCTATGGCCTGCTGGAGGAGTCTCAGAATCAGCAGGAGAA
GAACGAGCAGGACCTGCTGGCCCTGGAT

BG505_SOSIP_VLC1-03_DS21_mC (SEQ ID NO: 58)
AENLWVTVYYGVPVWKDAETTLFCASDAKAYETEKHNVWATHACVPTDPN
PQEIHLENVTEEFNMWKNNMVEQMHTDIISLWDQSLKPCCKLTPLCVTLQ
CTDWDNATLANMTGEIKNCSFNMTTELRDKKQKVYSLFYELDIIPIENEY
ISNNNTSNTSYRLINCNTSAITQACPKVSFEPIPIHYCAPAGFAILKCKD
KKFNGTGPCPSVSTVQCTHGIKPVVSTQLLLNGSLAEEEVMIRSENITNN
AKNILVQFNTPVQINCTRPNNNTRKSIRIGPGCAFYATGDIIGDIRQAHC
NVSATQWEQTLKGIAAKLLEHFGNNTIIRFANSSGGDLEVTTHSFNCGGE
FFYCNTSGLFNGSSWNLNKTKENTTNLENGTITLPCRIKQIINMWQRIGQ
AMYAPPIQGVIRCVSNITGLILTRDGGNKSAGIETFRPGGGDMRDNWRSE
LYKYKVVKIEPLGVAPTRCKRRVVGRRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALD (SEQ ID NO: 59)
GCTGAAAATCTGTGGGTCACTGTGTATTATGGGGTGCCTGTGTGGAAAGA
CGCTGAGACTACTCTGTTCTGTGCCTCCGACGCTAAAGCCTACGAAACCG
AGAAGCACAACGTGTGGGCAACCCATGCCTGCGTCCCTACAGACCCAAAT
CCCCAGGAAATCCACCTGGAGAATGTGACAGAGGAGTTCAACATGTGGAA
AAACAATATGGTGGAGCAGATGCATACTGACATCATTAGCCTGTGGGATC
AGTCCCTGAAGCCTTGCTGCAAACTGACCCCACTGTGCGTCACCCTGCAG
TGTACAGACTGGGATAATGCTACCCTGGCAAACATGACAGGCGAAATCAA
GAATTGTAGTTTCAACATGACCACAGAGCTGAGGGACAAGAAACAGAAAG
TGTACTCCCTGTTTTATGAACTGGACATCATTCCCATCGAAAACGAGTAC
ATCTCTAACAACAACACAAGTAACACTTCATATCGCCTGATCAACTGCAA
TACTAGCGCCATTACCCAGGCTTGTCCAAAGGTGTCCTTTGAGCCTATCC
CAATTCATTACTGCGCCCCCGCTGGCTTCGCCATCCTGAAGTGTAAAGAT
AAGAAGTTCAACGGCACCGGGCCATGCCCTTCCGTGTCTACAGTCCAGTG
TACTCACGGAATTAAGCCAGTGGTCAGTACACAGCTGCTGCTGAACGGCT
CACTGGCAGAGGAAGAAGTGATGATCCGGAGCGAGAACATCACAAACAAC
GCTAAGAACATCCTGGTCAGTTCAACACTCCCGTCCAGATTAATTGCAC
TAGACCTAACAACAACACCCGGAAAAGCATCAGAATTGGACCCGGCTGCG
CCTTTTATGCTACCGGCGACATCATTGGCGACATCCGGCAGGCCCACTGT
AACGTGAGCGCTACTCAGTGGGAACAGACCCTGAAGGGGATTGCCGCTAA
ACTGCTGGAGCATTTCGGAAACAATACCATCATTAGATTTGCCAACAGCT
CCGGCGGGGACCTGGAAGTGACTACCCACTCTTTCAATTGCGGAGGCGAG
TTCTTTTACTGTAACACTAGTGGACTGTTTAATGGCTCTAGTTGGAACCT

```
GAATAAGACCAAAGAAAACACAACTAATCTGGAGAACGGCACCATCACAC
TGCCCTGCCGAATTAAGCAGATCATTAACATGTGGCAGCGGATCGGCCAG
GCAATGTATGCCCCCCTATCCAGGGCGTGATCAGATGTGTCTCCAACAT
CACAGGACTGATTCTGACTAGGGATGGGGGAAACAAGTCTGCCGGGATCG
AGACTTTCAGGCCTGGCGGGGGAGACATGAGGGATAACTGGCGCTCCGAA
CTGTACAAGTATAAAGTGGTCAAGATCGAGCCACTGGGAGTGGCTCCAAC
ACGATGCAAACGAAGAGTGGTCGGAAGGCGACGACGAAGAAGGGCTGTGG
GAATCGGAGCAGTCTTCCTGGGCTTTCTGGGGGCAGCCGGATCAACAATG
GGCGCTGCAAGCATGACTCTGACCGTGCAGGCACGAAACCTGCTGTCCGG
AATCGTCCAGCAGCAGTCTAATCTGCTGCGAGCTCCTGAAGCACAGCAGC
ATCTGCTGAAGCTGACAGTGTGGGGCATCAAGCAGCTGCAGGCACGGGTG
CTGGCAGTCGAGCGCTATCTGCGAGACCAGCAGCTGCTGGGCATCTGGGG
GTGTTCTGGAAAGCTGATTTGCTGTACCAATGTGCCCTGGAACAGCAGCT
GGTCTAACAGGAATCTGAGTGAAATCTGGGACAATGACCTGGCTGCAG
TGGGATAAGGAGATTTCAAATTACACACGATCATCTACGGCCTGCTGGA
AGAGAGCCAGAATCAGCAGGAGAAGAACGAGCAGGACCTGCTGGCCCTGG
AT
```

BG505_SOSIP_VLC2-04_DS21_mC (SEQ ID NO: 60)
AENLWVTVYYGVPVWKDAETTLFCASDAKAYETEKHNVWATHACVPTDPN
PQEIHLENVTEEFNMWKNNMVEQMHTDIISLWDQSLKPCCKLTPLCVTLQ
CSDYEGNTTRQNITMKEEKGEIKNCSFNMTTELRDKKQKVYSLFYKLDIT
PIEEDNNSNNSSSANSSNSNANYTNYRLINCNTSAITQACPKVSFEPIPI
HYCAPAGFAILKCKDKKFNGTGPCPSVSTVQCTHGIKPVVSTQLLLNGSL
AEEEVMIRSENITNNAKNILVQFNTPVQINCTRPNNNTRKSIRIGPGCAF
YATGDIIGDIRQAHCNVSGTKWKNTLKQIVKKLGDHFGNNTIIRFANSSG
GDLEVTTHSFNCGGEFFYCNTSGLFNSTWNRTNGTWNDVEGLNYTNGNDT
ITLPCRIKQIINMWQRIGQAMYAPPIQGVIRCVSNITGLILTRDGGNDTD
KNETFRPGGGDMRDNWRSELYKYKVVKIEPLGVAPTRCKRRVVGRRRRR
AVGIGAVFLGFLGAAGSTMGAASMTLTVQARNLLSGIVQQQSNLLRAPEA
QQHLLKLTVWGIKQLQARVLAVERYLRDQQLLGIWGCSGKLICCTNVPWN
SSWSNRNLSEIWDNMTWLQWDKEISNYTQIIYGLLEESQNQQEKNEQDLL
ALD (SEQ ID NO: 61)
```
GCCGAAAATCTGTGGGTCACTGTGTATTATGGGGTCCCTGTGTGGAAGGA
TGCCGAAACTACTCTGTTCTGTGCCTCCGACGCCAAAGCCTACGAAACCG
AGAAGCACAATGTGTGGGCCACCCATGCTTGCGTCCCTACAGACCCAAAC
CCCCAGGAAATCCACCTGGAGAACGTGACAGAGGAGTTCAACATGTGGAA
AAACAATATGGTCGAACAGATGCATACTGACATCATTTCCCTGTGGGATC
AGTCTCTGAAGCCTTGCTGCAAACTGACACCACTGTGCGTCACTCTGCAG
TGTTCCGACTATGAGGGCAACACCACACGGCAGAATATCACCATGAAGGA
GGAAAAAGGGGAAATTAAGAACTGTTCATTCAATATGACTACCGAGCTGA
```

```
GAGATAAGAAACAGAAGGTGTACAGCCTGTTTTATAAACTGGACATCACT
CCCATTGAGGAAGATAACAATAGCAACAATAGCTCCTCTGCAAATAGTTC
AAATTCCAACGCCAATTACACCAACTATAGGCTGATCAACTGCAATACCA
GTGCAATTACACAGGCCTGTCCAAAGGTGTCATTTGAGCCTATCCCAATT
CATTACTGCGCTCCCGCAGGCTTCGCCATCCTGAAGTGTAAAGATAAGAA
GTTCAACGGCACCGGGCCATGCCCCTTCAGTGAGCACTGTCCAGTGTACCC
ACGGGATCAAGCCAGTGGTCTCCACACAGCTGCTGCTGAATGGATCTCTG
GCTGAGGAAGAAGTGATGATCAGGAGCGAGAACATTACCAACAATGCAAA
GAACATCCTGGTGCAGTTCAATACACCCGTCCAGATTAACTGCACTCGCC
CTAACAATAACACCCGGAAATCCATCAGAATTGGACCCGGCTGCGCATTT
TATGCCACCGGCGACATCATTGGCGACATCAGGCAGGCCCACTGTAATGT
GTCTGGCACCAAGTGGAAAAACACACTGAAGCAGATTGTGAAGAAACTGG
GAGACCATTTCGGCAATAACAATCATTCGCTTTGCTAATAGCTCCGGC
GGGGATCTGGAAGTGACAACTCACAGCTTCAACTGCGGAGGCGAGTTCTT
TTACTGTAATACAAGTGGCCTGTTTAACTCAACTTGGAACCGCACAAATG
GGACTTGGAATGACGTGGAGGGGCTGAACTATACCAACGGAAATGATACC
ATCACACTGCCCTGCCGAATTAAGCAGATCATTAATATGTGGCAGCGGAT
CGGCCAGGCTATGTACGCACCCCCTATCCAGGGCGTGATCAGATGTGTCA
GTAACATCACTGGACTGATTCTGACCAGGGACGGGGGAAACGACACAGAT
AAAAATGAGACTTTCCGGCCTGGCGGGGGAGACATGAGGGATAACTGGCG
CTCTGAACTGTACAAGTATAAAGTGGTCAAGATCGAGCCACTGGGAGTGG
CCCCCACAAGATGCAAACGAAGAGTGGTCGGAAGGCGACGACGAAGAAGG
GCAGTGGGATCGGAGCTGTCTTCCTGGGCTTTCTGGGGCCGCTGGATC
TACTATGGGAGCAGCCAGTATGACTCTGACCGTGCAGGCTCGCAATCTGC
TGTCAGGGATCGTCCAGCAGCAGAGCAACCTGCTGCGAGCCCCTGAAGCT
CAGCAGCATCTGCTGAAGCTGACCGTGTGGGGCATCAAGCAGCTGCAGGC
TCGGGTGCTGGCAGTCGAGCGCTACCTGCGAGATCAGCAGCTGCTGGGCA
TCTGGGGGTGTAGCGGAAAGCTGATTTGCTGTACAAACGTGCCCTGGAAC
AGCAGCTGGAGCAACAGAAATCTGTCCGAAATCTGGGACAATATGACTTG
GCTGCAGTGGGATAAGGAGATTTCTAACTACACCCAGATCATCTACGGCC
TGCTGGAAGAGAGTCAGAACCAGCAGGAGAAGAACGAGCAGGACCTGCTG
GCCCTGGAT
```

BG505_SOSIP_VLC2-08_DS21_mC (SEQ ID NO: 62)
AENLWVTVYYGVPVWKDAETTLFCASDAKAYETEKHNVWATHACVPTDPN
PQEIHLENVTEEFNMWKNNMVEQMHTDIISLWDQSLKPCCKLTPLCVTLQ
CVTLKNCSNSNCSISRNISIEMDGEIKNCSFNMTTELRDKKQKVYSLFYR
LDIVPIESSNNSQLSNNSQVSNNSQSSNYSQYRLINCNTSAITQACPKVS
FEPIPIHYCAPAGFAILKCKDKKFNGTGPCPSVSTVQCTHGIKPVVSTQL
LLNGSLAEEEVMIRSENITNNAKNILVQFNTPVQINCTRPNNNTRKSIRI
GPGCAFYATGDIIGDIRQAHCNVSKKDWEKTLQQVATKLGQHFGNNTIIR
FANSSGGDLEVTTHSFNCGGEFFYCNTSGLFNSTWIRNSSNSTWNSSASN

STELNSNITLPCRIKQIINMWQRIGQAMYAPPIQGVIRCVSNITGLILTR

DGGHETENKTETFRPGGGDMRDNWRSELYKYKVVKIEPLGVAPTRCKRRV

VGRRRRRRAVGIGAVFLGFLGAAGSTMGAASMTLTVQARNLLSGIVQQQS

NLLRAPEAQQHLLKLTVWGIKQLQARVLAVERYLRDQQLLGIWGCSGKLI

CCTNVPWNSSWSNRNLSEIWDNMTWLQWDKEISNYTQIIYGLLEESQNQQ

EKNEQDLLALD (SEQ ID NO: 63)
GCCGAAAATCTGTGGGTCACTGTGTATTATGGCGTGCCCGTGTGGAAGGA

TGCCGAAACTACTCTGTTCTGTGCCTCCGATGCTAAAGCCTACGAAACCG

AGAAGCACAACGTGTGGGCCACTCATGCTTGCGTCCCTACCGACCCAAAT

CCCCAGGAAATCCACCTGGAGAATGTGACAGAGGAGTTCAACATGTGGAA

AAACAATATGGTCGAGCAGATGCATACTGACATCATTAGCCTGTGGGATC

AGTCCCTGAAGCCTTGCTGCAAACTGACCCCACTGTGCGTGACACTGCAG

TGTGTCACTCTGAAGAACTGCTCTAATAGTAACTGTTCAATCAGCAGGAA

TATCAGCATTGAAATGGATGGCGAGATTAAGAATTGTTCCTTCAACATGA

CCACAGAACTGAGAGACAAGAAACAGAAAGTGTACTCCCTGTTCTACCGG

CTGGACATCGTCCCCATTGAGAGCTCCAACAATAGCCAGCTGTCCAACAA

TTCTCAGGTGAGTAACAATTCACAGTCTAGTAACTACTCTCAGTATCGCC

TGATCAATTGCAACACTAGTGCAATTACCCAGGCCTGTCCAAAGGTGTCA

TTTGAGCCTATCCCAATTCATTACTGCGCTCCCGCAGGCTTCGCCATCCT

GAAGTGTAAAGACAAGAAGTTCAACGGCACCGGGCCATGCCCTTCCGTGT

CTACAGTCCAGTGTACTCACGGCATTAAGCCAGTGGTCAGCACACAGCTG

CTGCTGAACGGGTCCCTGGCAGAGGAAGAAGTGATGATCAGGTCTGAGAA

TATTACCAACAATGCCAAGAATATCCTGGTGCAGTTCAACACACCCGTCC

AGATTAATTGCACACGCCCTAACAATAACACTCGGAAATCTATCAGAATT

GGACCCGGCTGCGCATTTTATGCCACAGGCGACATCATTGGCGACATCAG

GCAGGCCCACTGTAACGTGAGCAAGAAAGACTGGGAGAAGACCCTGCAGC

AGGTGGCTACAAAACTGGGACAGCATTTCGGCAATAACACCATCATTCGC

TTTGCAAACTCAAGCGGCGGGGATCTGGAAGTGACTACCCACAGCTTCAA

TTGCGGAGGCGAGTTCTTTTACTGTAACACTTCTGGCCTGTTTAATAGTA

CCTGGATCAGAAACAGCAGCAACAGCACCTGGAATAGTTCAGCTAGTAAC

TCAACAGAGCTGAACAGCAACATCACTCTGCCCTGCCGAATTAAGCAGAT

CATTAACATGTGGCAGCGGATCGGCAGGCTATGTATGCACCCCCTATCC

AGGGAGTGATTCGCTGTGTCAGCAATATCACCGGCCTGATTCTGACACGA

GACGGGGGACATGAAACCGAGAACAAAACAGAGACTTTCCGGCCTGGCGG

GGGAGACATGAGGGATAATTGGCGCTCCGAACTGTACAAGTATAAAGTGG

TCAAGATCGAGCCACTGGGGGTGGCCCCCACTAGATGCAAACGGAGAGTG

GTCGGAAGGCGACGACGAAGAAGGGCAGTGGGAATCGGAGCTGTCTTCCT

GGGCTTTCTGGGAGCAGCTGGCAGCACAATGGGCGCAGCCTCTATGACCC

TGACAGTGCAGGCTCGGAACCTGCTGAGTGGCATCGTCCAGCAGCAGTCA

AATCTGCTGAGAGCCCCTGAAGCTCAGCAGCACCTGCTGAAGCTGACAGT

GTGGGGCATCAAGCAGCTGCAGGCTCGGGTGCTGGCAGTCGAGCGCTATC

TGCGAGATCAGCAGCTGCTGGGCATCTGGGGGTGTAGCGGAAAGCTGATT

TGCTGTACTAATGTGCCCTGGAACAGCAGCTGGTCAAATAGAAACCTGAG

CGAAATCTGGGACAACATGACTTGGCTGCAGTGGGATAAGGAGATTTCTA

ATTACACCCAGATCATCTACGGCCTGCTGGAAGAGAGTCAGAATCAGCAG

GAGAAGAACGAGCAGGACCTGCTGGCCCTGGAT

BG505_SOSIP_VLC3-13_DS21_mC (SEQ ID NO: 64)
AENLWVTVYYGVPVWKDAETTLFCASDAKAYETEKHNVWATHACVPTDPN

PQEIHLENVTEEFNMWKNNMVEQMHTDIISLWDQSLKPCCKLTPLCVTLQ

CTNAALTNVTITNGPNITEEIRNCSFNMTTELRDKKQKVYSLFYKLDLVQ

INGSGGEYRLINCNTSAITQACPKVSFEPIPIHYCAPAGFAILKCKDKKF

NGTGPCPSVSTVQCTHGIKPVVSTQLLLNGSLAEEEVMIRSENITNNAKN

ILVQFNTPVQINCTRPNNNTRKSIRIGPGCAFYATGDIIGDIRQAHCNVS

GTKWNETLKQVAGKLRKHFGNNTIIRFANSSGGDLEVTTHSFNCGGEFFY

CNTSGLFNSTWPENGTMEGSNGTITLPCRIKQIINMWQRIGQAMYAPPIQ

GVIRCVSNITGLILTRDGGNSTTDTETFRPGGGDMRDNWRSELYKYKVVK

IEPLGVAPTRCKRRVVGRRRRRRAVGIGAVFLGFLGAAGSTMGAASMTLT

VQARNLLSGIVQQQSNLLRAPEAQQHLLKLTVWGIKQLQARVLAVERYLR

DQQLLGIWGCSGKLICCTNVPWNSSWSNRNLSEIWDNMTWLQWDKEISNY

TQIIYGLLEESQNQQEKNEQDLLALD (SEQ ID NO: 65)
GCCGAAAATCTGTGGGTGACTGTCTATTATGGGGTCCCTGTGTGGAAGGA

TGCCGAAACTACTCTGTTCTGTGCCAGCGATGCTAAGGCCTACGAAACCG

AGAAGCACAATGTGTGGGCAACCCATGCCTGCGTCCCTACAGACCCAAAC

CCCCAGGAAATCCACCTGGAGAATGTGACCGAGGAGTTCAACATGTGGAA

AAACAATATGGTGGAACAGATGCATACAGACATCATTTCCCTGTGGGATC

AGTCTCTGAAGCCTTGCTGCAAACTGACCCCACTGTGCGTCACTCTGCAG

TGTACCAATGCCGCTCTGACCAACGTGACCATCACAAATGGCCCAAACAT

CACAGAGGAAATTCGCAATTGTTCTTTCAACATGACCACAGAGCTGCGAG

ACAAGAAACAGAAGGTGTACAGCCTGTTTTATAAACTGGATCTGGTCCAG

ATCAATGGGTCCGGCGGGAATACAGGCTGATCAATTGCAACACAAGTGC

TATTACTCAGGCATGTCCAAAGGTGTCATTTGAGCCTATCCCAATTCATT

ATTGCGCCCCGCTGGCTTCGCCATCCTGAAGTGTAAAGACAAGAAGTTC

AACGGAACTGGCCCCTGCCCTTCAGTGAGCACCGTCCAGTGTACACACGG

CATTAAGCCAGTGGTCTCCACCCAGCTGCTGCTGAATGGGTCTCTGGCTG

AGGAAGAAGTGATGATCCGGTCCGAGAACATTACTAACAATGCAAAGAAT

ATCCTGGTGCAGTTCAACACCCCCGTCCAGATTAATTGCACTAGACCTAA

CAATAACACCCGGAAATCCATCAGAATTGGGCCCGGATGCGCTTTTTATG

CAACCGGGGACATCATTGGCGACATCCGCCAGGCCCACTGTAATGTGTCT

GGCACTAAGTGGAACGAGACCCTGAAACAGGTGGCCGGCAAGCTGCGAAA

ACATTTCGGGAATAACACAATCATTCGGTTTGCTAATAGCTCCGGAGGCG

-continued

```
ATCTGGAAGTGACTACCCACAGTTTCAACTGCGGGGGAGAGTTCTTTTAC
TGTAACACTAGTGGACTGTTTAATTCAACATGGCCTGAAAACGGCACTAT
GGAGGGCAGCAATGGCACTATCACCCTGCCATGCAGAATTAAGCAGATCA
TTAACATGTGGCAGAGGATCGGGCAGGCCATGTATGCTCCCCCTATCCAG
GGAGTGATTCGGTGTGTCTCAAATATCACAGGCCTGATTCTGACTAGAGA
CGGCGGGAACAGCACAACTGATACAGAGACTTTCAGGCCCGGAGGCGGGG
ACATGAGGGATAACTGGCGCAGCGAACTGTACAAGTATAAAGTGGTCAAG
ATCGAGCCACTGGGAGTGGCACCAACCCGATGCAAACGAAGAGTGGTCGG
AAGGCGACGACGAAGAAGGGCAGTGGGCATTGGGGCCGTCTTCCTGGGGT
TTCTGGGAGCAGCCGGCTCTACAATGGGAGCTGCAAGTATGACCCTGACA
GTGCAGGCTAGGAATCTGCTGTCAGGCATCGTCCAGCAGCAGAGCAACCT
GCTGCGAGCACCAGAAGCACAGCAGCATCTGCTGAAGCTGACCGTGTGGG
GCATCAAGCAGCTGCAGGCCCGGGTGCTGGCTGTCGAGCGCTACCTGCGA
GATCAGCAGCTGCTGGGGATCTGGGGATGTAGCGGCAAGCTGATTTGCTG
TACAAATGTGCCTTGGAACTCTAGTTGGAGCAATAGAAACCTGTCCGAAA
TCTGGGACAATATGACATGGCTGCAGTGGGATAAGGAGATTTCTAACTAC
ACTCAGATCATCTACGGCCTGCTGGAAGAGAGTCAGAATCAGCAGGAGAA
GAACGAGCAGGACCTGCTGGCCCTGGAT
```

Strain B.US.1998.AC10_029.AY835446 stabilized by olio6 mutations

```
AC10_SOSIP_olio6_mC
                                        (SEQ ID NO: 66)
AVEQTWVTVYYGVPVWKEANTTLFCASDAKAYNTEVHNVWATHACVPTDP
NPQEVELENVTENFNMWKNNMVDQMHEDIISLWDQSLKPCVKLTPLCVTL
SCTDNVGNDTSTNNSRWDKMEKGEIKNCSFNITTNMRDKMQKQYALFWKL
DVVPIEEGKNNNSSFTDYRLISCNTSVITQACPKVTFEPIPIHYCAPAGF
ALLKCKDKKFNGTGPCKNVSTVQCTHGIKPVVSTQLLLNGSLAEEEVVIR
SENFSNNARTIIVQLNTSVEIKCIAPNNFTVKGIHIGPGRAFYYMGDIIG
DIRQAHCNISRQNWNNTLKQIAEKLREQFGNKTIVFRQSSGGDPEIVMHT
FNCAGMFFYCNTAELFNSTWYANGTISIGGGNKTNIILPCRIKLFINMWQ
EVGKAMYAPPISGQIRCSSNITGLLLTRDGGRGNQTDNQTEIFRPVGGDM
KNNWRSELYKYKVVRIEPLGIAPTRCKRRVVGRRRRRRAVGIGALSLGFL
GAAGSTMGAASMTLTVQARLLLSGIVQQQNNLLRAPEPQQHLLQDTHWGI
KQLQARVLAVEHYLRDQQLLGIWGCSGKLICCTAVPWNVSWNNRSVDDIW
ENMTWMQWDREISNYTSLIYTLIEESQNQQEKNEQELLALD
```

```
                                        (SEQ ID NO: 67)
GCCGTGGAGCAGACCTGGGTGACAGTGTACTATGGCGTGCCCGTGTGGAA
GGAGGCCAACACCACACTGTTCTGCGCCAGCGACGCCAAGGCCTACAACA
CCGAGGTGCACAACGTGTGGGCAACCCACGCATGCGTGCCTACAGATCCA
AATCCCCAGGAGGTGGAGCTGGAGAACGTGACAGAGAACTTCAACATGTG
GAAGAACAATATGGTGGACCAGATGCACGAGGACATCATCTCTCTGTGGG
ACCAGAGCCTGAAGCCTTGCGTGAAGCTGACCCCACTGTGCGTGACCCTG
TCTTGTACAGACAATGTGGGCAACGATACCAGCACAAACAATTCCAGATG
GGATAAGATGGAGAAGGGCGAGATCAAGAATTGTAGCTTCAACATCACCA
CAAATATGAGGGACAAGATGCAGAAGCAGTACGCCCTGTTTTGGAAGCTG
GATGTGGTGCCCATCGAGGAGGGCAAGAACAATAACAGCTCCTTCACCGA
CTATAGACTGATCTCTTGCAATACCAGCGTGATCACACAGGCCTGTCCAA
AGGTGACATTTGAGCCTATCCCAATCCACTACTGCGCACCAGCAGGATTC
GCACTGCTGAAGTGTAAGGATAAGAAGTTTAATGGCACCGGCCCTTGCAA
GAACGTGTCCACCGTGCAGTGTACACACGGCATCAAGCCAGTGGTGTCTA
CACAGCTGCTGCTGAACGGCAGCCTGGCCGAGGAGGAGGTGGTCATCCGG
TCCGAGAATTTCTCTAATAACGCCAGAACCATCATCGTGCAGCTGAACAC
ATCCGTGGAGATCAAGTGCATCGCCCCCAATAACTTCACCGTGAAGGGCA
TCCACATCGGCCCTGGCAGGGCCTTTTACTATATGGGCGACATCATCGGC
GACATCAGGCAGGCCCACTGTAACATCTCTCGCCAGAATTGGAATAACAC
CCTGAAGCAGATCGCCGAGAAGCTGCGCGAGCAGTTCGGCAATAAGACAA
TCGTGTTTCGGCAGTCTAGCGGCGGCGACCCAGAGATCGTGATGCACACC
TTCAACTGCGCCGGCATGTTCTTTTACTGTAACACAGCCGAGCTGTTTAA
TTCCACCTGGTATGCCAACGGCACAATCTCTATCGGCGGCGGCAATAAGA
CCAACATCATCCTGCCCTGCCGCATCAAGCTGTTCATCAATATGTGGCAG
GAAGTGGGCAAGGCAATGTACGCACCACCTATCAGCGGACAGATCAGGTG
TTCCTCTAACATCACCGGCCTGCTGCTGACACGGGACGGCGGCAGAGGAA
ACCAGACCGATAATCAGACAGAGATCTTTAGACCTGTGGGCGGCGATATG
AAGAATAACTGGCGGTCCGAGCTGTACAAGTATAAGGTGGTGAGAATCGA
GCCACTGGGAATCGCACCAACCAGGTGCAAGAGGAGAGTGGTGGGCAGGC
GCCGGAGAAGGCGCGCAGTGGGCATCGGCGCCCTGAGCCTGGGCTTTCTG
GGAGCAGCAGGCAGCACAATGGGCGCAGCCTCCATGACCCTGACAGTGCA
GGCCAGACTGCTGCTGTCCGGCATCGTGCAGCAGCAGAATAACCTGCTGA
GGGCCCCCGAGCCTCAGCAGCACCTGCTGCAGGACACCCACTGGGGCATC
AAGCAGCTGCAGGCCAGGGTGCTGGCAGTGGAGCACTATCTGCGCGATCA
GCAGCTGCTGGGCATCTGGGGCTGCTCTGGCAAGCTGATCTGCTGTACCG
CCGTGCCCTGGAACGTGTCCTGGAATAACCGCTCTGTGGACGACATCTGG
GAGAATATGACATGGATGCAGTGGGACCGGGAGATCAGCAACTACACCTC
CCTGATCTATACACTGATCGAGGAGTCCCAGAACCAGCAGGAGAAGAATG
AGCAGGAGCTGCTGGCCCTGGAT
```

Resurfaced BG505 SOSIP trimer

```
BG505_SOSIP_MD39_SET224_wLoops_4_mC
(BG505_SOSIP_R4_mC)
                                        (SEQ ID NO: 68)
AENLWVTVYYGVPVWKDAETTLFCASDAKAYSTEKHNVWATHACVPTDPN
PQEVVLENVTENFNMWKNNMVEQMHEDIISLWDQSLKPCVKLTPLCVTLN
CTELNDTNTTATNSSGRVIEDKEIKNCSFNMTTSLRDKVQRVYSLFNKFD
```

```
IVPIDNSNDSYRLISCNTSAITQACPKVSFEPIPIHYCAPAGFAILKCND
KEFNGTGPCKSVSTVQCTHGIRPVVSTQLLLNGSLAEEEVIIRSENFTNN
AKTILVQLNEPVVINCTRPNNNTVKSIRIGPGQAFYYTGEIIGDIRQAHC
TVSRETWNKTLGRVVEQLREQFRNKTIIVFNQSSGGDPEIVMHSFNCGGE
FFYCNSTQLFNSTWYGNETETGGTNDTIGNITLPCRIKQIINMWQEVGKA
MYAPPIRGQISCSSNITGLILTRDGGNNNETNTTETFRPGGGDMRDNWRS
ELYKYKVVKIEPLGVAPTKCKRRVVGRRRRRRAVGIGAMSLGFLGAAGST
MGAASLTLTVQARNLLSGIVQQQSNLLRAPEPQQHLLKDTHWGIKQLQAR
VLAVEHYLRDQQLLGIWGCSGKLICCTNVPWNTSWSNKSLDQIWDNMTWL
EWDREISNYTQLIYNLLEESQNQQEKNEQDLLALD
```
(SEQ ID NO: 69)
```
GCCGAGAATCTGTGGGTGACCGTGTACTATGGCGTGCCCGTGTGGAAGGA
CGCAGAGACCACACTGTTCTGCGCCTCCGATGCCAAGGCCTACTCTACAG
AGAAGCACAACGTGTGGGCAACCCACGCATGCGTGCCTACAGACCCAAAT
CCCCAGGAGGTGGTGCTGGAGAACGTGACCGAGAACTTTAATATGTGGAA
GAACAATATGGTGGAGCAGATGCACGAGGACATCATCTCTCTGTGGGATC
AGAGCCTGAAGCCTTGCGTGAAGCTGACCCCACTGTGCGTGACCCTGAAT
TGTACAGAGCTGAACGACACCAATACCACAGCCACAAACAGCTCCGGCAG
AGTGATCGAGGATAAGGAGATCAAGAACTGTAGCTTCAATATGACCCAT
CCCTGCGGGACAAGGTGCAGAGAGTGTACTCCCTGTTCAATAAGTTTGAT
ATCGTGCCTATCGACAACTCCAATGATTCTTATAGACTGATCAGCTGCAA
CACCTCCGCCATCACACAGGCCTGTCCAAAGGTGTCTTTTGAGCCTATCC
CAATCCACTACTGCGCACCAGCAGGATTCGCAATCCTGAAGTGTAACGAC
AAGGAGTTTAATGGCACCGGCCCTTGCAAGAGCGTGTCCACCGTGCAGTG
TACACACGGCATCCGGCCAGTGGTGTCTACACAGCTGCTGCTGAATGGCA
GCCTGGCCGAGGAGGAAGTGATCATCAGAAGCGAGAACTTCACCAACAAT
GCCAAGACAATCCTGGTGCAGCTGAACGAGCCCGTGGTCATCAACTGCAC
CAGGCCTAACAATAACACAGTGAAGTCTATCCGCATCGGCCCAGGCCAGG
CCTTTTACTATACCGGCGAGATCATCGGCGATATCAGGCAGGCCCACTGT
ACAGTGAGCCGCGAGACCTGGAACAAGACACTGGGAAGGGTGGTGGAGCA
GCTGAGGGAGCAGTTCAGAAATAAGACCATCATCGTGTTTAACCAGTCTA
GCGGCGGCGACCCAGAGATCGTGATGCACTCCTTCAACTGCGGCGGCGAG
TTCTTTTACTGTAACTCTACCCAGCTGTTTAATAGCACATGGTATGGCAA
CGAGACCGAGACAGGCGGCACCAACGATACAATCGGCAATATCACCCTGC
CCTGCAGGATCAAGCAGATCATCAATATGTGGCAGGAAGTGGGCAAGGCA
ATGTACGCACCACCTATCAGGGGACAGATCAGCTGTTCCTCTAACATCAC
CGGCCTGATCCTGACAAGGGACGGAGGCAATAACAATGAGACCAATACCA
CAGAGACATTCAGACCCGGCGGCGGCGACATGAGGGATAACTGGCGCTCC
GAGCTGTACAAGTATAAGGTGGTGAAGATCGAGCCACTGGGAGTGGCCAC
AACCAAGTGCAAGAGGAGAGTGGTGGGCAGGCGCCGGAGAAGGCGCGCAG
TGGGCATCGGCGCCATGAGCCTGGGCTTTCTGGGAGCAGCAGGATCCACA
ATGGGAGCAGCCTCTCTGACCCTGACAGTGCAGGCCAGGAATCTGCTGAG
CGGCATCGTGCAGCAGCAGTCCAACCTGCTGAGGGCACCAGAGCCTCAGC
AGCACCTGCTGAAGGACACCCACTGGGGCATCAAGCAGCTGCAGGCACGG
GTGCTGGCAGTGGAGCACTATCTGAGAGATCAGCAGCTGCTGGGAATCTG
GGGATGCAGCGGCAAGCTGATCTGCTGTACCAACGTGCCTTGGAATACAT
CTTGGAGCAATAAGTCCCTGGACCAGATCTGGGATAACATGACCTGGCTG
GAGTGGGATAGAGAGATCTCCAATTACACACAGCTGATCTATAACCTGCT
GGAGGAGTCTCAGAACCAGCAGGAGAAGAATGAGCAGGACCTGCTGGCCC
TGGAT
```

VI: Additional Trimer Modifications that Add Functionality and that can be Combined with Other Types of Modifications

Filling conserved glycan holes on BG505: introduction of con

-continued

```
AAGAAGTTTAATGGCACCGGCCCTTGCCAGAACGTGTCCACCGTGCAGTG
TACACACGGCATCAAGCCAGTGGTGAGCACACAGCTGCTGCTGAATGGCT
CCCTGGCCGAGGAGGAAGTGATCATCCGGTCTGAGAACATCACCAACAAT
GCCAAGAATATCCTGGTGCAGCTGAACACAAGCGTGCAGATCAATTGCAC
CAGGCCCAACAATAACACAGTGAAGTCCATCCGCATCGGCCCTGGCCAGG
CCTTTTACTATACCGGCGACATCATCGGCGACATCAGACAGGCCCACTGT
AACGTGAGCAAGGCCACCTGGAACGAGACACTGGGCAAGGTGGTGAAGCA
GCTGCGGAAGCACTTCGGCAATAACACCATCATCAGATTTGCACAGAGCA
GCGGAGGCGACCTGGAGGTGACCACACACTCCTTCAATTGCGGCGGCGAG
TTCTTTTACTGTAACACATCCGGCCTGTTTAATTCTACCTGGATCTCTAA
CACAAGCGTGCAGGGCTCCAATTCTACCGGCTCCAACGATTCTATCACAC
TGCCATGCAGGATCAAGCAGATCATCAACATGTGGCAGAGGATCGGACAG
GCAATGTATGCACCACCTATCCAGGGCGTGATCAGATGCGTGAGCAATAT
CACCGGCCTGATCCTGACACGCGACGGAGGCAGCACCAACTCCACCACAG
AGACATTCAGGCCCGGCGGAGGCGACATGAGGGATAACTGGAGATCCGAG
CTGTACAAGTATAAGGTGGTGAAGATCGAGCCACTGGGAGTGGCACCAAC
CAGGTGCAAGAGGAGAGTGGTGGGCAGGCGCCGGAGAAGGCGCGCAGTGG
GCATCGGAGCCGTGAGCCTGGGCTTTCTGGGAGCAGCAGGCTCTACAATG
GGCGCAGCCAGCATGACCCTGACAGTGCAGGCCCGGAATCTGCTGTCCGG
CATCGTGCAGCAGCAGTCTAACCTGCTGAGAGCCCCCGAGCCTCAGCAGC
ACCTGCTGAAGGACACCCACTGGGGCATCAAGCAGCTGCAGGCCAGAGTG
CTGGCCGTGGAGCACTACCTGAGAGATCAGCAGCTGCTGGGCATCTGGGG
ATGCTCCGGCAAGCTGATCTGCTGTACCAATGTGCCTTGGAACTCTAGCT
GGAGCAATAGAAACCTGTCCGAGATCTGGGACAATATGACCTGGCTGCAG
TGGGATAAGGAGATCTCCAACTACACACAGATCATCTATGGCCTGCTGGA
GGAGTCTCAGAATCAGCAGGAGAAGAACGAGCAGGACCTGCTGGCCCTGG
AT
```

C-terminal cysteine constructed used for conjugations. This modification can be added to any trimer.

BG505_SOSIP_D664_MD39_CtCys_mC
(SEQ ID NO: 72)
AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVIIRSENITNN
AKNILVQLNTPVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVSLGFLGAAGSTM

GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALDGTKHHHHHHC (SEQ ID NO: 73)
```
GCCGAAAATCTGTGGGTGACTGTCTACTATGGCGTGCCTGTCTGGAAGGA
CGCCGAGACCACACTGTTCTGTGCTTCCGATGCTAAGGCATACGAAACCG
AGAAACACAACGTGTGGGCAACCCATGCCTGCGTCCCAACAGACCCAAAC
CCCCAGGAAATCCACCTGGAGAATGTGACCGAGGAGTTCAACATGTGGAA
GAACAATATGGTGGAACAGATGCATGAGGACATCATTTCCCTGTGGGATC
AGTCTCTGAAGCCTTGCGTGAAACTGACCCCACTGTGCGTGACACTGCAG
TGTACAAACGTCACTAACAATATCACCGACGATATGCGGGGCGAACTGAA
GAATTGTTCTTTCAACATGACTACCGAGCTGAGGGACAAGAAACAGAAAG
TGTACAGTCTGTTTTATCGCCTGGATGTGGTCCAGATCAATGAAACCAG
GGGAATCGAAGTAACAATTCAAACAAGGAGTACCGGCTGATTAATTGCAA
CACCAGTGCCATCACACAGGCTTGTCCAAAAGTGTCATTCGAGCCTATCC
CAATTCATTATTGCGCCCCCGCTGGCTTCGCCATCCTGAAGTGTAAAGAT
AAGAAGTTCAACGGCACCGGGCCATGCCCTTCAGTGAGCACTGTCCAGTG
TACCCACGGAATTAAGCCTGTGGTCTCCACACAGCTGCTGCTGAATGGCT
CTCTGGCTGAGGAAGAAGTGATCATTAGGTCTGAGAACATCACTAACAAT
GCAAAGAATATTCTGGTGCAGCTGAACACCCCCGTCCAGATCAATTGCAC
TCGCCCTAACAATAACACCGTGAAATCTATCCGAATTGGACCCGGCCAGG
CTTTTTATTACACCGGCGACATCATTGGCGACATCAGACAGGCACACTGC
AATGTGAGCAAGGCCACATGGAACGAGACTCTGGGGAAGGTGGTCAAACA
GCTGCGCAAACATTTCGGAAATAACACAATCATTCGATTTGCACAGAGCA
GCGGAGGGGACCTGGAAGTGACAACTCACAGCTTCAATTGCGGAGGCGAG
TTCTTTTACTGTAACACTAGTGGCCTGTTTAATTCAACTTGGATCAGCAA
CACCTCCGTGCAGGGCAGCAACAGCACCGGCTCTAACGATAGTATCACAC
TGCCATGTCGGATTAAGCAGATCATTAACATGTGGCAGAGAATCGGGCAG
GCCATGTATGCACCCCCTATCCAGGGAGTGATTCGATGCGTGAGCAATAT
CACAGGCCTGATTCTGACTAGAGACGGGGGATCAACAAACAGCACCACAG
AGACTTTCCGGCCCGGCGAGGAGACATGCGAGATAACTGGAGATCCGAA
CTGTACAAGTATAAAGTGGTCAAGATCGAGCCACTGGGCGTGGCTCCCAC
CAGATGCAAACGAAGAGTGGTCGGGAGGCGCCGACGGAGAAGGGCTGTGG
GGATTGGAGCAGTCAGCCTGGCTTTCTGGGGGCCGCTGGATCTACAATG
GGGGCAGCCAGTATGACTCTGACCGTGCAGGCCAGGAATCTGCTGTCAGG
AATCGTGCAGCAGCAGAGCAACCTGCTGAGGGCTCCCGAACCCCAGCAGC
ACCTGCTGAAGGACACCCACTGGGGCATCAAGCAGCTGCAGGCAAGAGTG
CTGGCCGTCGAGCATTACCTGAGGGATCAGCAGCTGCTGGGCATCTGGGG
ATGCAGCGGAAAGCTGATTTGCTGTACAAATGTGCCTTGGAACTCTAGTT
GGAGCAATCGCAACCTGTCCGAAATCTGGGACAATATGACATGGCTGCAG
TGGGATAAGGAGATTAGCAACTACACTCAGATCATCTACGGCCTGCTGGA
```

-continued

AGAGTCCCAGAATCAGCAGGAGAAGAACGAGCAGGACCTGCTGGCCCTGG

ATGGTACCAAGCACCACCATCACCATCACTGT

\# Computational designed mutation knocks out binding of CD4 receptor, yet retains antigenic profile of BG505 CD4bs. In this case Applicants illustrate the mutation on the MD39 background.

BG505_SOSIP_D664_MD39_CD4KO4_mC (SEQ ID NO: 74)
AENLWVTVYYGVPVWKDAETTLFCASDAKAYETEKHNVWATHACVPTDPN

PQEIHLENVTEEFNMWKNNMVEQMHEDIISLWDQSLKPCVKLTPLCVTLQ

CTNVTNNITDDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVIIRSENITNN

AKNILVQLNTPVQINCTRPNNNTVKSIRIGPGQAFYYTGDIIGDIRQAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGTDMRDNWRSE

LYKYKVVKIEPLGVAPTRCKRRVVGRRRRRRAVGIGAVSLGFLGAAGSTM

GAASMTLTVQARNLLSGIVQQQSNLLRAPEPQQHLLKDTHWGIKQLQARV

LAVEHYLRDQQLLGIWGCSGKLICCTNVPWNSSWSNRNLSEIWDNMTWLQ

WDKEISNYTQIIYGLLEESQNQQEKNEQDLLALD (SEQ ID NO: 75)
GCCGAAAATCTGTGGGTGACTGTCTACTATGGCGTGCCTGTCTGGAAGGA

CGCCGAGACCACACTGTTCTGTGCTTCCGATGCTAAGGCATACGAAACCG

AGAAACACAACGTGTGGGCAACCCATGCCTGCGTCCCAACAGACCCAAAC

CCCCAGGAAATCCACCTGGAGAATGTGACCGAGGAGTTCAACATGTGGAA

GAACAATATGGTGGAACAGATGCATGAGGACATCATTTCCCTGTGGGATC

AGTCTCTGAAGCCTTGCGTGAAACTGACCCCACTGTGCGTGACACTGCAG

TGTACAAACGTCACTAACAATATCACCGACGATATGCGGGGCGAACTGAA

GAATTGTTCTTTCAACATGACTACCGAGCTGAGGGACAAGAAACAGAAAG

TGTACAGTCTGTTTTATCGCCTGGATGTGGTCCAGATCAATGAAAACCAG

GGGAATCGAAGTAACAATTCAAACAAGGAGTACCGGCTGATTAATTGCAA

CACCAGTGCCATCACACAGGCTTGTCCAAAAGTGTCATTCGAGCCTATCC

CAATTCATTATTGCGCCCCCGCTGGCTTCGCCATCCTGAAGTGTAAAGAT

AAGAAGTTCAACGGCACCGGGCCATGCCCTTCAGTGAGCACTGTCCAGTG

TACCCACGGAATTAAGCCTGTGGTCTCCACACAGCTGCTGCTGAATGGCT

CTCTGGCTGAGGAAGAAGTGATCATTAGGTCTGAGAACATCACTAACAAT

GCAAAGAATATTCTGGTGCAGCTGAACACCCCCGTCCAGATCAATTGCAC

TCGCCCTAACAATAACACCGTGAAATCTATCCGAATTGGACCCGGCCAGG

CTTTTTATTACACCGGCGACATCATTGGCGACATCAGACAGGCACACTGC

AATGTGAGCAAGGCCACATGGAACGAGACTCTGGGGAAGGTGGTCAAACA

GCTGCGCAAACATTTCGGAAATAACACAATCATTCGATTTGCACAGAGCA

-continued

GCGGAGGGGACCTGGAAGTGACAACTCACAGCTTCAATTGCGGAGGCGAG

TTCTTTTACTGTAACACTAGTGGCCTGTTTAATTCAACTTGGATCAGCAA

CACCTCCGTGCAGGGCAGCAACAGCACCGGCTCTAACGATAGTATCACAC

TGCCATGTCGGATTAAGCAGATCATTAACATGTGGCAGAGAATCGGGCAG

GCCATGTATGCACCCCCTATCCAGGGAGTGATTCGATGCGTGAGCAATAT

CACAGGCCTGATTCTGACTAGAGACGGGGGATCAACAAACAGCACCACAG

AGACTTTCCGGCCCGGCGGAACCGACATGCGAGATAACTGGAGATCCGAA

CTGTACAAGTATAAAGTGGTCAAGATCGAGCCACTGGGCGTGGCTCCCAC

CAGATGCAAACGAAGAGTGGTCGGGAGGCGCCGACGGAGAAGGGCTGTGG

GGATTGGAGCAGTCAGCCTGGGCTTTCTGGGGGCCGCTGGATCTACAATG

GGGGCAGCCAGTATGACTCTGACCGTGCAGGCCAGGAATCTGCTGTCAGG

AATCGTGCAGCAGCAGAGCAACCTGCTGAGGGCTCCCGAACCCCAGCAGC

ACCTGCTGAAGGACACCCACTGGGGCATCAAGCAGCTGCAGGCAAGAGTG

CTGGCCGTCGAGCATTACCTGAGGGATCAGCAGCTGCTGGGCATCTGGGG

ATGCAGCGGAAAGCTGATTTGCTGTACAAATGTGCCTTGGAACTCTAGTT

GGAGCAATCGCAACCTGTCCGAAATCTGGGACAATATGACATGGCTGCAG

TGGGATAAGGAGATTAGCAACTACACTCAGATCATCTACGGCCTGCTGGA

AGAGTCCCAGAATCAGCAGGAGAAGAACGAGCAGGACCTGCTGGCCCTGG

AT

\# Computational designed mutation knocks out binding of CD4 receptor, yet retains antigenic profile of BG505 CD4bs. Here the mutation is shown on the olio6 background.

BG505_SOSIP_D664_olio6_CD4KO4_mC (SEQ ID NO: 76)
AENLWVTVYYGVPVWKDAETTLFCASDAKAYETEKHNVWATHACVPTDPN

PQEIHLENVTEEFNMWKNNMVEQMHEDIISLWDQSLKPCVKLTPLCVTLQ

CTNVTNNITDDMRGELKNCSFNMTTELRDKKQKVYSLFWRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVIIRSENITNN

AKNILVQLNTPVQINCTAPNNFTVKSIRIGPGQAFYYMGDIIGDIRQAHC

NVSKATWNETLGKVVKQLRKHFGNNTIIRFAQSSGGDLEVTTHSFNCGGM

FFYCNTSGLFNSTWISNTSVQGSNSTGSNDSITLPCRIKLIINMWQRIGQ

AMYAPPIQGVIRCVSNITGLILTRDGGSTNSTTETFRPGGTDMRDNWRSE

LYKYKVVKIEPLGVAPTRCKRRVVGRRRRRRAVGIGAVSLGFLGAAGSTM

GAASMTLTVQARNLLSGIVQQQSNLLRAPEPQQHLLKDTHWGIKQLQARV

LAVEHYLRDQQLLGIWGCSGKLICCTNVPWNSSWSNRNLSEIWDNMTWLQ

WDKEISNYTQIIYGLLEESQNQQEKNEQDLLALD (SEQ ID NO: 77)
GCCGAAAACCTGTGGGTGACTGTCTACTATGGCGTGCCCGTCTGGAAGGA

CGCAGAGACCACACTGTTCTGCGCTAGCGATGCTAAGGCCTACGAGACCG

AGAAACACAACGTGTGGGCAACCCATGCCTGCGTGCCTACAGACCCAAAT

-continued

CCCCAGGAAATCCACCTGGAGAACGTGACCGAGGAGTTCAACATGTGGAA
GAACAATATGGTGGAACAGATGCATGAGGACATCATTTCCCTGTGGGATC
AGTCTCTGAAGCCCTGCGTGAAACTGACCCCTCTGTGCGTCACACTGCAG
TGTACAAACGTGACTAACAATATCACCGACGATATGCGGGGCGAACTGAA
GAACTGTTCTTTCAATATGACTACCGAGCTGCGCGACAAGAAACAGAAAG
TGTACAGTCTGTTTTGGCGACTGGATGTGGTCCAGATCAACGAAAATCAG
GGGAACCGGAGTAACAACTCAAATAAGGAGTATAGACTGATCAACTGCAA
TACCAGTGCCATTACACAGGCTTGTCCTAAAGTGTCATTCGAGCCTATCC
CAATTCATTACTGCGCCCCAGCTGGCTTCGCCATCCTGAAGTGTAAAGAT
AAGAAGTTCAACGGCACCGGGCCATGCCCTTCAGTGAGCACTGTCCAGTG
TACCCACGGAATTAAGCCTGTGGTCTCCACACAGCTGCTGCTGAACGGCT
CTCTGGCTGAGGAAGAAGTGATCATTAGATCCGAGAATATCACTAACAAT
GCAAAGAACATTCTGGTGCAGCTGAATACCCCAGTCCAGATCAACTGCAC
TGCCCCCAACAATTTCACCGTGAAATCTATCCGGATTGGACCAGGCCAGG
CTTTTTACTATATGGGCGACATCATTGGGGATATTAGACAGGCACACTGT
AACGTGAGCAAGGCCACATGGAATGAAACTCTGGGGAAGGTGGTCAAACA
GCTGCGAAAACATTTCGGAAACAATACAATCATTCGATTTGCACAGAGCA
GCGGAGGGGACCTGGAGGTGACAACTCACAGCTTCAACTGCGGAGGCATG
TTCTTTTATTGTAATACTAGTGGCCTGTTTAACTCAACTTGGATCAGCAA
TACCTCCGTGCAGGGCAGCAACAGCACCGGCTCTAATGATAGTATCACAC
TGCCATGCAGAATTAAGCTGATCATTAATATGTGGCAGAGGATCGGGCAG
GCTATGTACGCACCCCCTATCCAGGGAGTGATTCGGTGCGTGAGCAACAT
CACAGGCCTGATTCTGACTAGAGACGGGGGATCAACAAATAGCACCACAG
AGACTTTCAGGCCCGGCGGAACCGACATGCGAGATAACTGGCGATCCGAA
CTGTACAAGTATAAAGTGGTCAAGATCGAGCCTCTGGGAGTGGCACCAAC
CCGATGCAAACGAAGAGTGGTCGGGAGGCGCCCGACGGAGAAGGGCTGTGG
GGATTGGAGCAGTCTCTCTGGGCTTTCTGGGGGCCGCTGGATCTACAATG
GGGGCAGCCAGTATGACTCTGACCGTCCAGGCAAGGAACCTGCTGTCAGG
AATCGTGCAGCAGCAGAGCAATCTGCTGCGCGCTCCAGAACCCCAGCAGC
ACCTGCTGAAGGACACCCATTGGGGCATCAAGCAGCTGCAGGCAAGGGTG
CTGGCAGTCGAGCACTACCTGCGAGATCAGCAGCTGCTGGGCATCTGGGG
ATGCAGCGGAAAGCTGATTTGCTGTACAAACGTGCCCTGGAACAGCAGCT
GGAGCAACCGGAATCTGTCCGAAATCTGGGACAACATGACATGGCTGCAG
TGGGATAAGGAGATTAGCAATTACACTCAGATCATCTACGGCCTGCTGGA
AGAGTCCCAGAACCAGCAGGAGAAGAACGAGCAGGACCTGCTGGCCCTGG
AT

Filling conserved glycan holes on AC10: introduction of conserved glycans missing from the AC10 strain: N295 is missing and in 62% of HIV strains, N386 is missing and in 86% of HIV strains AC10_SOSIP_olio6_congly_mC (SEQ ID NO: 78)

AVEQTWVTVYYGVPVWKEANTTLFCASDAKAYNTEVHNVWATHACVPTDP
NPQEVELENVTENFNMWKNNMVDQMHEDIISLWDQSLKPCVKLTPLCVTL
SCTDNVGNDTSTNNSRWDKMEKGEIKNCSFNITTNMRDKMQKQYALFWKL
DVVPIEEGKNNNSSFTDYRLISCNTSVITQACPKVTFEPIPIHYCAPAGF
ALLKCKDKKFNGTGPCKNVSTVQCTHGIKPVVSTQLLLNGSLAEEEVVIR
SENFSNNARTIIVQLNTSVEINCTAPNNFTVKGIHIGPGRAFYYMGDIIG
DIRQAHCNISRQNWNNTLKQIAEKLREQFGNKTIVFRQSSGGDPEIVMHT
FNCAGMFFYCNTSELFNSTWYANGTISIGGGNKTNIILPCRIKLFINMWQ
EVGKAMYAPPISGQIRCSSNITGLLLTRDGGRGNQTDNQTEIFRPVGGDM
KNNWRSELYKYKVVRIEPLGIAPTRCKRRVVGRRRRRRAVGIGALSLGFL
GAAGSTMGAASMTLTVQARLLLSGIVQQQNNLLRAPEPQQHLLQDTHWGI
KQLQARVLAVEHYLRDQQLLGIWGCSGKLICCTAVPWNVSWNNRSVDDIW
ENMTWMQWDREISNYTSLIYTLIEESQNQQEKNEQELLALD (SEQ ID NO: 79)

GCCGTGGAGCAGACCTGGGTGACAGTGTACTATGGCGTGCCCGTGTGGAA
GGAGGCCAACACCACACTGTTCTGCGCCAGCGACGCCAAGGCCTACAACA
CCGAGGTGCACAACGTGTGGGCAACCCACGCATGCGTGCCTACAGATCCA
AATCCCCAGGAGGTGGAGCTGGAGAACGTGACAGAGAACTTCAACATGTG
GAAGAACAATATGGTGGACCAGATGCACGAGGACATCATCTCTCTGTGGG
ACCAGAGCCTGAAGCCTTGCGTGAAGCTGACCCCACTGTGCGTGACCCTG
TCTTGTACAGACAATGTGGGCAACGATACCAGCACAAACAATTCCAGATG
GGATAAGATGGAGAAGGGCGAGATCAAGAATTGTAGCTTCAACATCACCA
CAAATATGAGGGACAAGATGCAGAAGCAGTACGCCCTGTTTTGGAAGCTG
GATGTGGTGCCCATCGAGGAGGGCAAGAACAATAACAGCTCCTTCACCGA
CTATAGACTGATCTCTTGCAATACCAGCGTGATCACACAGGCCTGTCCAA
AGGTGACATTTGAGCCTATCCCAATCCACTACTGCGCACCAGCAGGATTC
GCACTGCTGAAGTGTAAGGATAAGAAGTTTAATGGCACCGGCCCTTGCAA
GAACGTGTCCACCGTGCAGTGTACACACGGCATCAAGCCAGTGGTGTCTA
CACAGCTGCTGCTGAACGGCAGCCTGGCCGAGGAGGAGGTGGTCATCCGG
TCCGAGAATTTCTCTAATAACGCCAGAACCATCATCGTGCAGCTGAACAC
ATCCGTGGAGATCAACTGCACCGCCCCCAATAACTTCACCGTGAAGGGCA
TCCACATCGGCCCTGGCAGGGCCTTTTACTATATGGGCGACATCATCGGC
GACATCAGGCAGGCCCACTGTAACATCTCTCGCCAGAATTGGAATAACAC
CCTGAAGCAGATCGCCGAGAAGCTGCGCGAGCAGTTCGGCAATAAGACAA
TCGTGTTTCGGCAGTCTAGCGGCGGCGACCCAGAGATCGTGATGCACACC
TTCAACTGCGCCGGCATGTTCTTTTACTGTAACACAAGCGAGCTGTTTAA
TTCCACCTGGTATGCCAACGGCACAATCTCTATCGGCGGCGGCAATAAGA

```
CCAACATCATCCTGCCCTGCCGCATCAAGCTGTTCATCAATATGTGGCAG

GAAGTGGGCAAGGCAATGTACGCACCACCTATCAGCGGACAGATCAGGTG

TTCCTCTAACATCACCGGCCTGCTGCTGACACGGGACGGCGGCAGAGGAA

ACCAGACCGATAATCAGACAGAGATCTTTAGACCTGTGGGCGGCGATATG

AAGAATAACTGGCGGTCCGAGCTGTACAAGTATAAGGTGGTGAGAATCGA

GCCACTGGGAATCGCACCAACCAGGTGCAAGAGGAGAGTGGTGGGCAGGC

GCCGGAGAAGGCGCGCAGTGGGCATCGGCGCCCTGAGCCTGGGCTTTCTG

GGAGCAGCAGGCAGCACAATGGGCGCAGCCTCCATGACCCTGACAGTGCA

GGCCAGACTGCTGCTGTCCGGCATCGTGCAGCAGCAGAATAACCTGCTGA

GGGCCCCCGAGCCTCAGCAGCACCTGCTGCAGGACACCCACTGGGGCATC

AAGCAGCTGCAGGCCAGGGTGCTGGCAGTGGAGCACTATCTGCGCGATCA

GCAGCTGCTGGGCATCTGGGGCTGCTCTGGCAAGCTGATCTGCTGTACCG

CCGTGCCCTGGAACGTGTCCTGGAATAACCGCTCTGTGGACGACATCTGG

GAGAATATGACATGGATGCAGTGGGACCGGGAGATCAGCAACTACACCTC

CCTGATCTATACACTGATCGAGGAGTCCCAGAACCAGCAGGAGAAGAATG

AGCAGGAGCTGCTGGCCCTGGAT
```

Type VII Sequences

191084_SOSIP_MD39
(SEQ ID NO: 80)
TENLWVTVYYGVPVWRDAETTLFCASDAKAYDTEMHNVWATHACVPTDPN
PQEIDLENVTEKFNMWKNNMVEQMHEDIISLWDQSLKPCVKLTPLCVTLN
CTAITNDTRGNETGINRTVETTEMTNCSFNMTTELRDRKKKVNALFYKLD
IVQIGENSSQYRLINCNTSVITQACPKVTFEPIPIHYCAPAGFAILKCK
DKEFNGTGTCRNVSSVQCTHGIKPVVSTQLLLNGSLAEGQVIIRSENISD
NAKTIIVQLNESVPINCTRPNNNTVRGIHLGPGQTFFYTDIIGDIRQAHC
NVSESKWNKALQEVVKQLRQHWNKTIIFKSSSGGDLEITTHSFNCGGEFF
YCNTSGLFNSTWNIAGNRTNDTKSNETITLPCRIKQIVNVWQRVGQAIYA
PPIAGVIRCNSITGLLLVRDGGATNNTDETFRPGGGNMRDNWRSELYKY
KVVKIEPLGVAPTRCRRRVVERRRRRRAVGLGAVSIGFLGAAGSTMGAAS
VTLTVQARQLLSGIVQQQSNLLRAPEPQQHLLKDTHWGIKQLQARVLAVE
HYLKDQQLLGIWGCSGKLICCTTVPWNSSWSNKSQNEIWDNMTWLQWDKE
ISNYTQLIYSLIEESQNQQEKNEQELLALD

001428_SOSIP_MD39
(SEQ ID NO: 81)
VENLWVTVYYGVPVWKEARTTLFCASDAKAYETEVHNVWATHACVPTDPN
PQEMVLGNVTENFNMWKNDMVDQMHEDVISLWAQSLKPCVKLTPLCVTLE
CTQVNATQGNTTQVNVTQVNGDEMKNCSFNTTTEIRDKKQKAYALFYRLD
LVPLERENRGDSNSASKYILINCNTSAITQACPKVNFDPIPIHYCTPAGY
AILKCNNKTFNGTGSCNNVSTVQCTHGIKPVVSTQLLLNGSLAEEEIIIR
SENLTDNVKTIIVHLDQSVEIVCTRPNNNTVKSIRIGPGQTFYYTGDIIG
NIREAHCNISEKKWHEMLRRVSEKLAEHFPNKTIKFTSSSGGDLEITTHS
FNCRGEFFYCNTSGLFNSTYMPNGTYMPNGTNNSNSTIILPCRIKQIINM

WQEVGPAMYAPPIAGNITCNSNITGLLLVRDGGKNNNTEIFRPGGGDMRD
NWRSELYKYKVVEIKPLGVAPTRCKRRVVGRRRRRRAVGLGAVSLGFLGA
AGSTMGAASITLTVQARQLLSGIVQQQSNLLQAPEPQQHLLQDTHWGIKQ
LQTRVLAIEHYLKDQQLLGIWGCSGKLICCTAVPWNSSWSNKSLTDIWDN
MTWMQWDREVSNYTGIIYRLLEDSQNQQERNEQDLLALD

AC10_SOSIP_MD39
(SEQ ID NO: 82)
AVEQTWVTVYYGVPVWKEANTTLFCASDAKAYNTEVHNVWATHACVPTDP
NPQEVELENVTENFNMWKNNMVDQMHEDIISLWDQSLKPCVKLTPLCVTL
SCTDNVGNDTSTNNSRWDKMEKGEIKNCSFNITTNMRDKMQKQYALFYKL
DVVPIEEGKNNNSSFTDYRLISCNTSVITQACPKVTFEPIPIHYCAPAGF
ALLKCKDKKFNGTGPCKNVSTVQCTHGIKPVVSTQLLLNGSLAEEEVVIR
SENFSNNARTIIVQLNTSVEIKCIRPNNNTVKGIHIGPGRAFYYTGDIIG
DIRQAHCNISRQNWNNTLKQIAEKLREQFGNKTIVFRQSSGGDPEIVMHT
FNCAGEFFYCNTAELFNSTWYANGTISIGGGNKTNIILPCRIKQFINMWQ
EVGKAMYAPPISGQIRCSSNITGLLLTRDGGRGNQTDNQTEIFRPVGGDM
KNNWRSELYKYKVVRIEPLGIAPTRCKRRVVGRRRRRRAVGIGALSLGFL
GAAGSTMGAASMTLTVQARLLLSGIVQQQNNLLRAPEPQQHLLQDTHWGI
KQLQARVLAVEHYLRDQQLLGIWGCSGKLICCTAVPWNVSWNNRSVDDIW
ENMTWMQWDREISNYTSLIYTLIEESQNQQEKNEQELLALD

AC10_SOSIP_olio6
(SEQ ID NO: 83)
AVEQTWVTVYYGVPVWKEANTTLFCASDAKAYNTEVHNVWATHACVPTDP
NPQEVELENVTENFNMWKNNMVDQMHEDIISLWDQSLKPCVKLTPLCVTL
SCTDNVGNDTSTNNSRWDKMEKGEIKNCSFNITTNMRDKMQKQYALFWKL
DVVPIEEGKNNNSSFTDYRLISCNTSVITQACPKVTFEPIPIHYCAPAGF
ALLKCKDKKFNGTGPCKNVSTVQCTHGIKPVVSTQLLLNGSLAEEEVVIR
SENFSNNARTIIVQLNTSVEIKCIAPNNFTVKGIHIGPGRAFYYMGDIIG
DIRQAHCNISRQNWNNTLKQIAEKLREQFGNKTIVFRQSSGGDPEIVMHT
FNCAGMFFYCNTAELFNSTWYANGTISIGGGNKTNIILPCRIKLFINMWQ
EVGKAMYAPPISGQIRCSSNITGLLLTRDGGRGNQTDNQTEIFRPVGGDM
KNNWRSELYKYKVVRIEPLGIAPTRCKRRVVGRRRRRRAVGIGALSLGFL
GAAGSTMGAASMTLTVQARLLLSGIVQQQNNLLRAPEPQQHLLQDTHWGI
KQLQARVLAVEHYLRDQQLLGIWGCSGKLICCTAVPWNVSWNNRSVDDIW
ENMTWMQWDREISNYTSLIYTLIEESQNQQEKNEQELLALD ZM197M_MD39
(SEQ ID NO: 84)
MEQLWVTVYYGVPVWKEAKATLFCASDAKAYEKEVHNVWATHACVPTDPN
PQEIPLGNVTENFNMWKNDMADQMHEDIISLWDQSLKPCVKLTPLCVTLN
CSDATSNTTKNATNTNTTSTDNRNATSNDTEMKGEIKNCTFNITTEVRDR
KTKQRALFYKLDVVPLEEEKNSSSKNSSYKEYRLISCNTSTITQACPKVS
FDPIPIHYCAPAGYAILKCNNKTFNGTGPCHNVSTVQCTHGIKPVVSTQL
LLNGSLAEEEIIIRSENLTDNTKTIIVHLNESVEINCTRPNNNTVKSVRI -continued

```
GPGQTFFYTGEIIGDIRQAHCNLSKSNWTTTLKRIEKKLKEHFNNATIKF

ESSAGGDLEITTHSFNCRGEFFYCNTSGLFNSSLLNDTDGTSNSTSNATI

TLPCRIKQIINMWQEVGRAMYASPIAGIITCKSNITGLLLTRDGGNKSAG

IETFRPGGGNMKDNWRSELYKYKVVEIKPLGIAPTSCKRRVVERRRRRRA

AGIGAVSLGFLGAAGSTMGAASVMLTVQARQLLSGIVQQQSNLLRAPEPQ

QHMLQDTHWGIKQLQTRVLAIEHYLKDQQLLGLWGCSGKLICCTAVPWNT

SWSNKSKDEIWDNMTWMQWDREIDNYTQVIYQLLEVSQNQQEKNENDLLA

LD
```

B41_SOSIP_D664_MD39

(SEQ ID NO: 85)
```
AAKKWVTVYYGVPVWKEATTTLFCASDAKAYDTEVHNVWATHACVPTDPN

PQEIVLGNVTENFNMWKNNMVEQMHEDIISLWDQSLKPCVKLTPLCVTLN

CNNVNTNNTNNSTNATISDWEKMETGEMKNCSFNVTTSIRDKIKKEYALF

YKLDVVPLENKNNINNTNITNYRLINCNTSVITQACPKVSFEPIPIHYCA

PAGFAILKCNSKTFNGSGPCTNVSTVQCTHGIRPVVSTQLLLNGSLAEEE

IVIRSENITNDNAKTIIVQLNEAVEINCTRPNNNTVKSIHIGPGRAFYYTG

DIIGNIRQAHCNISKARWNETLGQIVAKLEEQFPNKTIIFNHSSGGDPEI

VTHSFNCGGEFFYCNTTPLFNSTWNNTRTDDYPTGGEQNITLQCRIKQII

NMWQGVGKAMYAPPIRGQIRCSSNITGLLLTRDGGRDQNGTETFRPGGGN

MRDNWRSELYKYKVVKIEPLGIAPTACKRRVVQRRRRRRAVGLGAFSLGF

LGAAGSTMGAASMALTVQARLLLSGIVQQQNNLLRAPEPQQHMLQDTHWG

IKQLQARVLAVEHYLRDQQLLGIWGCSGKIICCTNVPWNDSWSNKTINEI

WDNMTWMQWEKEIDNYTQHIYTLLEVSQIQQEKNEQELLELD
```

Type VIII Sequences gp120-gp41 linker optimized by mammalian display directed evolution

BG505_SOSIP_MD39_link14

(SEQ ID NO: 86)
```
AENLWVTVYYGVPVWKDAETTLFCASDAKAYETEKHNVWATHACVPTDPN

PQEIHLENVTEEFNMWKNNMVEQMHEDIISLWDQSLKPCVKLTPLCVTLQ

CTNVTNNITDDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVIIRSENITNN

AKNILVQLNTPVQINCTRPNNNTVKSIRIGPGQAFYYTGDIIGDIRQAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGSHSGSGGGSGSGGHAAVGIGAVSLGF

LGAAGSTMGAASMTLTVQARNLLSGIVQQQSNLLRAPEPQQHLLKDTHWG

IKQLQARVLAVEHYLRDQQLLGIWGCSGKLICCTNVPWNSSWSNRNLSEI

WDNMTWLQWDKEISNYTQIIYGLLEESQNQQEKNEQDLLALD
```

The following "CP" designs are all circular permutations of gp140 that eliminate the need for a cleavage site while maintaining native-like structure.
Circular permutation 1, variant 1

BG505_SOSIP_MD39_CP1.1

(SEQ ID NO: 87)
```
VSLGFLGAAGSTMGAASMTLTVQARNLLSGIVQQQSNLLRAPEPQQHLLK

DTHWGIKQLQARVLAVEHYLRDQQLLGIWGCSGKLICCTNVPWNSSWSNR

NLSEIWDNMTWLQWDKEISNYTQIIYGLLEESQNQQEKNEQDLLALDGGS

GSGGGSGSGGSSAENLWVTVYYGVPVWKDAETTLFCASDAKAYETEKHNV

WATHACVPTDPNPQEIHLENVTEEFNMWKNNMVEQMHEDIISLWDQSLKP

CVKLTPLCVTLQCTNVTNNITDDMRGELKNCSFNMTTELRDKKQKVYSLF

YRLDVVQINENQGNRSNNSNKEYRLINCNTSAITQACPKVSFEPIPIHYC

APAGFAILKCKDKKFNGTGPCPSVSTVQCTHGIKPVVSTQLLLNGSLAEE

EVIIRSENITNNAKNILVQLNTPVQINCTRPNNNTVKSIRIGPGQAFYYT

GDIIGDIRQAHCNVSKATWNETLGKVVKQLRKHFGNNTIIRFAQSSGGDL

EVTTHSFNCGGEFFYCNTSGLFNSTWISNTSVQGSNSTGSNDSITLPCRI

KQIINMWQRIGQAMYAPPIQGVIRCVSNITGLILTRDGGSTNSTTETFRP

GGGDMRDNWRSELYKYKVVKIEPLGVAPTRCKRRVVG
```

Circular permutation 1, variant 2

BG505_SOSIP_MD39_CP1.2

(SEQ ID NO: 88)
```
VSLGFLGAAGSTMGAASMTLTVQARNLLSGIVQQQSNLLRAPEPQQHLLK

DTHWGIKQLQARVLAVEHYLRDQQLLGIWGCSGKLICCTNVPWNSSWSNR

NLSEIWDNMTWLQWDKEISNYTQIIYGLLEESQNQQEKNEQDLGGSGSGG

GSGSGGSSGSGLWVTVYYGVPVWKDAETTLFCASDAKAYETEKHNVWATH

ACVPTDPNPQEIHLENVTEEFNMWKNNMVEQMHEDIISLWDQSLKPCVKL

TPLCVTLQCTNVTNNITDDMRGELKNCSFNMTTELRDKKQKVYSLFYRLD

VVQINENQGNRSNNSNKEYRLINCNTSAITQACPKVSFEPIPIHYCAPAG

FAILKCKDKKFNGTGPCPSVSTVQCTHGIKPVVSTQLLLNGSLAEEEVII

RSENITNNAKNILVQLNTPVQINCTRPNNNTVKSIRIGPGQAFYYTGDII

GDIRQAHCNVSKATWNETLGKVVKQLRKHFGNNTIIRFAQSSGGDLEVTT

HSFNCGGEFFYCNTSGLFNSTWISNTSVQGSNSTGSNDSITLPCRIKQII

NMWQRIGQAMYAPPIQGVIRCVSNITGLILTRDGGSTNSTTETFRPGGGD

MRDNWRSELYKYKVVKIEPLGVAPTRCKRR
```

Circular Permutation 2

BG505_SOSIP_MD39_CP2

(SEQ ID NO: 89)
```
VSLGFLGAAGSTMGAASMTLTVQARNLLSGIVQQQSNLLRAPEPQQHLLK

DTHWGIKQLQARVLAVEHYLRDQQLLGIWGCSGKLICCTGGSGVTYYGV

PVWKDAETTLFCASDAKAYETEKHNVWATHACVPTDPNPQEIHLENVTEE

FNMWKNNMVEQMHEDIISLWDQSLKPCVKLTPLCVTLQCTNVTNNITDDM

RGELKNCSFNMTTELRDKKQKVYSLFYRLDVVQINENQGNRSNNSNKEYR
```

-continued

LINCNTSAITQACPKVSFEPIPIHYCAP<u>A</u>GFAILKCKD<u>K</u>KFNGTGPCPSV

STVQCTH<u>G</u>IKPVVSTQLLLNGSLAEEE<u>V</u>IIRSENITN<u>N</u>AKNILVQLNTPV

QINCTRPNNNTVKSIRIGPGQAFYYTG<u>D</u>IIGDIRQAHCNVSKATWNETLG

KVVKQLRKHFGNNTIIRFAQSSGGDLEVTTHSFNCGGEFFYCNTSGLFNS

TWISNTSVQGSNSTGSNDSITLPCRIKQIINNMWQRIGQAMYAPPIQGVIR

CVSNITGLILTRDGGSTNSTTETFRPGGGDMRDNWRSELYKYKVVKIEPL

GVAPTRCKRGGSGSGVPWNSSWSNRNLSEIWDNMTWLQWDKEISNYTQII

YGLLEESQNQQEKNEQDLLALD

Circular Permutation 3

BG505_SOSIP_MD39_CP3
(SEQ ID NO: 90)
VSLGFLGAAGS<u>T</u>MGAASMTLTVQARNLLSGIVQQQSNLLRAPEPQQHLLK

DT<u>H</u>WGIKQLQARVLAVEHYLRDQQLLGIWGCSGKLICCTNVPWNSSWSNR

NLSEIWDNMTWLQWDKEISNYTQIIYGLLEESGGSGSGAGGLWVTVYYGV

PVWK<u>D</u>AETT<u>L</u>FCAS<u>D</u>AKAYETEKHN<u>V</u>WATHACVPTDPNPQEIHLENVTEE

FNMWKN<u>N</u>MVEQMHEDIISLWDQSLKPC<u>V</u>KLTPLCVTLQCTNVTNNITDDM

RGELKNCSFNMTTELRDKKQKVYSLFYRLDVVQINENQGNRSNNSNKEYR

LINCNTSAITQACPKVSFEPIPIHYCAP<u>A</u>GFAILKCKD<u>K</u>KFNGTGPCPSV

STVQCTH<u>G</u>IKPVVSTQLLLNGSLAEEE<u>V</u>IIRSENITN<u>N</u>AKNILVQLNTPV

QINCTRPNNNTVKSIRIGPGQAFYYTG<u>D</u>IIGDIRQAHCNVSKATWNETLG

KVVKQLRKHFGNNTIIRFAQSSGGDLEVTTHSFNCGGEFFYCNTSGLFNS

TWISNTSVQGSNSTGSNDSITLPCRIKQIINNMWQRIGQAMYAPPIQGVIR

CVSNITGLILTRDGGSTNSTTETFRPGGGDMRDNWRSELYKYKVVKIEPL

GVAPTRCKRRVVGGGSGSGQNQQEKNEQDLLALD

Type IX Sequences
BG505 MD39 GRSF4 adds glycosylation sites at positions 80, 241, 289, 657, and 665 relative to MD39.

BG505_MD39_GRSF4
(SEQ ID NO: 91)
AENLWVTVYYGVPVWKDAETTLFCASDAKAYETEKHNVWATHACVPTDPN

SSEIHLENVTEEFNMWKNNMVEQMHEDIISLWDQSLKPCVKLTPLCVTLQ

CTNVTNNITDDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCQNVSTVQCTHGIKPVVSTQLLLNGSLAEEEVIIRSENITNN

AKNILVQLNTSVQINCTRPNNNTVKSIRIGPGQAFYYTGDIIGDIRQAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVSLGFLGAAGSTM

GAASMTLTVQARNLLSGIVQQQSNLLRAPEPQQHLLKDTHWGIKQLQARV

LAVEHYLRDQQLLGIWGCSGKLICCTNVPWNSSWSNANLSEIWDNMTWLQ

WDKNISNYTQIIYGLLEESQNQQEKNNQSLLALDNGS

BG505 MD39 GRSF7 adds one additional glycosylation site, at position 634, on top of MD39 GRSF4. Adding this glycosylation site is accomplished by the mutation E634N, but that breaks a salt bridge with R617, so we added the R617A mutation. In total, BG505 MD39 GRSF7 contains six extra glycosylation sites relative to BG505 MD39.

BG505_MD39_GRSF7
(SEQ ID NO: 92)
AENLWVTVYYGVPVWKDAETTLFCASDAKAYETEKHNVWATHACVPTDPN

SSEIHLENVTEEFNMWKNNMVEQMHEDIISLWDQSLKPCVKLTPLCVTLQ

CTNVTNNITDDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCQNVSTVQCTHGIKPVVSTQLLLNGSLAEEEVIIRSENITNN

AKNILVQLNTSVQINCTRPNNNTVKSIRIGPGQAFYYTGDIIGDIRQAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVSLGFLGAAGSTM

GAASMTLTVQARNLLSGIVQQQSNLLRAPEPQQHLLKDTHWGIKQLQARV

LAVEHYLRDQQLLGIWGCSGKLICCTNVPWNSSWSNANLSEIWDNMTWLQ

WDKNISNYTQIIYGLLEESQNQQEKNNQSLLALDNGS

BG505 CP1.2 GRSF4 adds five glycosylation sites relative to BG505 CP1.2, but some of the additional glycosylation sites are different than those in BG505_MD39_GRSF4.

BG505_MD39_CP1.2_GRSF4
(SEQ ID NO: 93)
VSLGFLGAAGSTMGAASMTLTVQARNLLSGIVQQQSNLLRAPEPQQHLLK

DTHWGIKQLQARVLAVEHYLRDQQLLGIWGCSGKLICCTNVPWNSSWSNR

NLSEIWDNMTWLQWDKEISNYTQIIYGLLEESQNQQEKNEQDLGGNGSGG

GSGSGGNGSSGLWVTVYYGVPVWKDAETTLFCASDAKAYETEKHNVWATH

ACVPTDPNSSEIHLENVTEEFNMWKNNMVEQMHEDIISLWDQSLKPCVKL

TPLCVTLQCTNVTNNITDDMRGELKNCSFNMTTELRDKKQKVYSLFYRLD

VVQINENQGNRSNNSNKEYRLINCNTSAITQACPKVSFEPIPIHYCAPAG

FAILKCKDKKFNGTGPCQNVSTVQCTHGIKPVVSTQLLLNGSLAEEEVII

RSENITNNAKNILVQLNTSVQINCTRPNNNTVKSIRIGPGQAFYYTGDII

GDIRQAHCNVSKATWNETLGKVVKQLRKHFGNNTIIRFAQSSGGDLEVTT

HSFNCGGEFFYCNTSGLFNSTWISNTSVQGSNSTGSNDSITLPCRIKQII

NMWQRIGQAMYAPPIQGVIRCVSNITGLILTRDGGSTNSTTETFRPGGGD

MRDNWRSELYKYKVVKIEPLGVAPTRCKRR

Merges the BG505_MD39_link14 modifications with glycan masking modifications in BG505 MD39 GRSF4.

BG505_MD39_link14_GRSF4
(SEQ ID NO: 94)
AENLWVTVYYGVPVWKDAETTLFCASDAKAYETEKHNVWATHACVPTDPN

SSEIHLENVTEEFNMWKNNMVEQMHEDIISLWDQSLKPCVKLTPLCVTLQ

```
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCQNVSTVQCTHGIKPVVSTQLLLNGSLAEEEVIIRSENITNN
AKNILVQLNTSVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGSHSGSGGSGSGGHAAVGIGAVSLGF
LGAAGSTMGAASMTLTVQARNLLSGIVQQQSNLLRAPEPQQHLLKDTHWG
IKQLQARVLAVEHYLRDQQLLGIWGCSGKLICCTNVPWNSSWSNRNLSEI
WDNMTWLQWDKEISNYTQIIYGLLEESQNQQEKNNQSLLALDNGS
```

Merges the BG505_MD39_link14 modifications with glycan masking modifications in BG505 MD39 GRSF7.

BG505_MD39_link14_GRSF7
(SEQ ID NO: 95)
```
AENLWVTVYYGVPVWKDAETTLFCASDAKAYETEKHNVWATHACVPTDPN
SSEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCQNVSTVQCTHGIKPVVSTQLLLNGSLAEEEVIIRSENITNN
AKNILVQLNTSVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGSHSGSGGSGSGGHAAVGIGAVSLGF
LGAAGSTMGAASMTLTVQARNLLSGIVQQQSNLLRAPEPQQHLLKDTHWG
IKQLQARVLAVEHYLRDQQLLGIWGCSGKLICCTNVPWNSSWSNANLSEI
WDNMTWLQWDKNISNYTQIIYGLLEESQNQQEKNNQSLLALDNGS
```

Type X Sequences
Cleavage-independent MD39 with "quiet" loops.
V1: D141N, R143S (as in VLC1-03), V1 is already short this adds 1 extra glycan to c-term of loop
V2b: Use VLC3-13 (hotspot, single glycan and 8 AA shorter)
V4: Use VLC3-13 (hotspot, 2 glycans and 5 AA shorter)

BG505_MD39_CP1.2_GRSF4_qLoops1
(SEQ ID NO: 96)
```
VSLGFLGAAGSTMGAASMTLTVQARNLLSGIVQQQSNLLRAPEPQQHLLK
DTHWGIKQLQARVLAVEHYLRDQQLLGIWGCSGKLICCTNVPWNSSWSNR
NLSEIWDNMTWLQWDKEISNYTQIIYGLLEESQNQQEKNEQDLGGNGSGG
GSGSGGNGSSGLWVTVYYGVPVWKDAETTLFCASDAKAYETEKHNVWATH
ACVPTDPNSSEIHLENVTEEFNMWKNNMVEQMHEDIISLWDQSLKPCVKL
TPLCVTLQCTNVTNNITDNMTGELKNCSFNMTTELRDKKQKVYSLFYRLD
VVQINGSGGEYRLINCNTSAITQACPKVSFEPIPIHYCAPAGFAILKCKD
KKFNGTGPCQNVSTVQCTHGIKPVVSTQLLLNGSLAEEEVIIRSENITNN
AKNILVQLNTSVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWPENGTMEGSNGTITLPCRIKQIINMWQRIGQAMYAP
PIQGVIRCVSNITGLILTRDGGSTNSTTETFRPGGGDMRDNWRSELYKYK
VVKIEPLGVAPTRCKRR
```

Same as BG505_MD39_CP1.2_GRSF4_qLoops1, but adds three additional glycosylation sites (indicated by underline, bold). (This GRSF7 adds more glycans that BG505 MD39_GRSF7).

BG505_MD39_CP1.2_GRSF7_qLoops1
(SEQ ID NO: 97)
```
GGNSSGSLGFLGAAGSTMGAASMTLTVQARNLLSGIVQQQSNLLRAPEPQ
QHLLKDTHWGIKQLQARVLAVEHYLRDQQLLGIWGCSGKLICCTNVPWNS
SWSNRNLSEIWDNMTWLQWDKEISNYTQIIYGLLEESQNQNESNEQDLGG
NGSGGGSGSGGNGSSGLWVTVYYGVPVWKDAETTLFCASDAKAYETEKHN
VWATHACVPTDPNSSEIHLENVTEEFNMWKNNMVEQMHEDIISLWDQSLK
PCVKLTPLCVTLQCTNVTNNITDNMTGELKNCSFNMTTELRDKKQKVYSL
FYRLDVVQINGSGGEYRLINCNTSAITQACPKVSFEPIPIHYCAPAGFAI
LKCKDKKFNGTGPCQNVSTVQCTHGIKPVVSTQLLLNGSLAEEEVIIRSE
NITNNAKNILVQLNTSVQINCTRPNNNTVKSIRIGPGQAFYYTGDIIGDI
RQAHCNVSKATWNETLGKVVKQLRKHFGNNTIIRFAQSSGGDLEVTTHSF
NCGGEFFYCNTSGLFNSTWPENGTMEGSNGTITLPCRIKQIINMWQRIGQ
AMYAPPIQGVIRCVSNITGLILTRDGGSTNSTTETFRPGGGDMRDNWRSE
LYKYKVVKIEPLGVAPTRCNRS
```

Cleavage-dependent BG505_MD39_GRSF4 but with "quiet" loops from BG505_MD39_CP1.2_GRSF4_qLoops1

BG505_MD39_GRSF4_qLoops1
(SEQ ID NO: 98)
```
AENLWVTVYYGVPVWKDAETTLFCASDAKAYETEKHNVWATHACVPTDPN
SSEIHLENVTEEFNMWKNNMVEQMHEDIISLWDQSLKPCVKLTPLCVTLQ
CTNVTNNITDNMTGELKNCSFNMTTELRDKKQKVYSLFYRLDVVQINGSG
GEYRLINCNTSAITQACPKVSFEPIPIHYCAPAGFAILKCKDKKFNGTGP
CQNVSTVQCTHGIKPVVSTQLLLNGSLAEEEVIIRSENITNNAKNILVQL
NTSVQINCTRPNNNTVKSIRIGPGQAFYYTGDIIGDIRQAHCNVSKATWN
ETLGKVVKQLRKHFGNNTIIRFAQSSGGDLEVTTHSFNCGGEFFYCNTSG
LFNSTWPENGTMEGSNGTITLPCRIKQIINMWQRIGQAMYAPPIQGVIRC
VSNITGLILTRDGGSTNSTTETFRPGGGDMRDNWRSELYKYKVVKIEPLG
VAPTRCKRRVVGRRRRRAVGIGAVSLGFLGAAGSTMGAASMTLTVQARN
LLSGIVQQQSNLLRAPEPQQHLLKDTHWGIKQLQARVLAVEHYLRDQQLL
GIWGCSGKLICCTNVPWNSSWSNRNLSEIWDNMTWLQWDKEISNYTQIIY
GLLEESQNQQEKNNQSLLALDNGS
```

Type XI Sequences

BG505 SOSIP MD39 fused via GSGG linker (SEQ ID NO: 116) to the *Pyrococcus furiosus* Ferritin sequence from PDB: 2JD6. Compared to the ferritin sequence in 2JD6, the first position in ferritin was mutated from M to G to contribute to the linker. Furthermore, another position within ferritin was mutated from R to K, to eliminate a potential furin cleavage site.

BG505_SOSIP_MD39_2JD6
(SEQ ID NO: 99)
AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVIIRSENITNN
AKNILVQLNTPVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVSLGFLGAAGSTM
GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALDGSGGLSERMLKALNDQ
LNRELYSAYLYFAMAAYFEDLGLEGFANWMKAQAEEEIGHALRFYNYIYD
KNGRVELDEIPKPPKEWESPLKAFEAAYEHEKFISKSIYELAALAEEEKD
YSTRAFLEWFINEQVEEEASVKKILDKLKFAKDSPQILFMLDKELSARAP
KLPGLLMQGGE**

BG505 SOSIP MD39 fused via ASG linker to a variant of Dihydrolipoyl Transacetylase (E2p) from *Bacillus Stearothermophilus*. The E2p sequence was obtained from PDB: 1B5S, and the single unpaired cysteine in that sequence was either left in place, mutated to A, or mutated to T, as indicated by the "[C/A/T]" expression in the sequence below. Applicants have found that expression levels are superior when the unpaired cysteine is left intact or when it is mutated to T. The data in FIG. 20 correspond to the particle with an A at that position.

BG505 SOSIP MD39 E2p (also referred to as "MD39-1b5s")
(SEQ ID NO: 100)
AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVIIRSENITNN
AKNILVQLNTPVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVSLGFLGAAGSTM
GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALDASGAAAKPATTEGEFP
ETREKMSGIRRAIAKAMVHSKHTAPHVTLMDEADVTKLVAHRKKFKAIAA
EKGIKLTFLPYVVKALVSALREYPVLNT[C/A/T]IDDETEEIIQKHYYN
IGIAADTDRGLLVPVIKHADRKPIFALAQEINELAEKARDGKLTPGEMKG
ASCTITNIGSAGGQWFTPVINHPEVAILGIGRIAEKPIVRDGEIVAAPML
ALSLSFDHRMIDGATAQKALNHIKRLLSDPELLLM**

Type XII Sequences

The first set in Type XII are cleavage-dependent, TM-anchored trimers, some with glycan masking.

BG505 SOSIP MD39 as gp160 but without cytoplasmic domain

BG505_MD39_gp160_dCT
(SEQ ID NO: 101)
PQEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVIIRSENITNN
AKNILVQLNTPVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVSLGFLGAAGSTM
GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALDKWASLWNWFDISNWLW
YIKIFIMIVGGLIGLRIVFAVLSVIHRVRQGYSPLS**

This is BG505_MD39_gp160_dCT but adds 3 glycosylation sites (80, 241, 289). These 3 additional glycans are a subset of the 5 additional glycans present in BG505 MD39 GRSF4.

BG505_MD39_gp160_dCT_GRSF4.1
(SEQ ID NO: 102)
AENLWVTVYYGVPVWKDAETTLFCASDAKAYETEKHNVWATHACVPTDPN
SSEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCQNVSTVQCTHGIKPVVSTQLLLNGSLAEEEVIIRSENITNN
AKNILVQLNTSVQINCTRPNNNTVKSIRIGPGQAFYYTGDIIGDIRQAHC
NVSKATWNETLGKVVKQLRKHFGNNTIIRFAQSSGGDLEVTTHSFNCGGE

-continued
```
FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVSLGFLGAAGSTM

GAASMTLTVQARNLLSGIVQQQSNLLRAPEPQQHLLKDTHWGIKQLQARV

LAVEHYLRDQQLLGIWGCSGKLICCTNVPWNSSWSNRNLSEIWDNMTWLQ

WDKEISNYTQIIYGLLEESQNQQEKNEQDLLALDKWASLWNWFDISNWLW

YIKIFIMIVGGLIGLRIVFAVLSVIHRVRQGYSPLS**
```
This is BG505_MD39_gp160_dCT_GRSF4.1 plus the CT domain.
Full-length gp160 including the Cytoplasmic domain.

BG505_MD39_gp160_GRSF4.1_m
(SEQ ID NO: 103)
```
AENLWVTVYYGVPVWKDAETTLFCASDAKAYETEKHNVWATHACVPTDPN

SSEIHLENVTEEFNMWKNNMVEQMHEDIISLWDQSLKPCVKLTPLCVTLQ

CTNVTNNITDDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCQNVSTVQCTHGIKPVVSTQLLLNGSLAEEEVIIRSENITNN

AKNILVQLNTSVQINCTRPNNNTVKSIRIGPGQAFYYTGDIIGDIRQAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVSLGFLGAAGSTM

GAASMTLTVQARNLLSGIVQQQSNLLRAPEPQQHLLKDTHWGIKQLQARV

LAVEHYLRDQQLLGIWGCSGKLICCTNVPWNSSWSNRNLSEIWDNMTWLQ

WDKEISNYTQIIYGLLEESQNQQEKNEQDLLALDKWASLWNWFDISNWLW

YIKIFIMIVGGLIGLRIVFAVLSVIHRVRQGYSPLSFQTHTPNPRGLDRP

ERIEEEDGEQDRGRSTRLVSGFLALAWDDLRSLCLFCYHRLRDFILIAAR

IVELLGHSSLKGLRLGWEGLKYLWNLLAYWGRELKISAINLFDTIAIAVA

EWTDRVIEIGQRLCRAFLHIPRRIRQGLERALL**
```
Same as BG505_MD39_gp160_dCT but using linker and PDGFR TM domain instead of native TM domain, for better expression.

BG505_MD39_gp140-PDGFR
(SEQ ID NO: 104)
```
AENLWVTVYYGVPVWKDAETTLFCASDAKAYETEKHNVWATHACVPTDPN

PQEIHLENVTEEFNMWKNNMVEQMHEDIISLWDQSLKPCVKLTPLCVTLQ

CTNVTNNITDDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVIIRSENITNN

AKNILVQLNTPVQINCTRPNNNTVKSIRIGPGQAFYYTGDIIGDIRQAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVSLGFLGAAGSTM

GAASMTLTVQARNLLSGIVQQQSNLLRAPEPQQHLLKDTHWGIKQLQARV

LAVEHYLRDQQLLGIWGCSGKLICCTNVPWNSSWSNRNLSEIWDNMTWLQ

WDKEISNYTQIIYGLLEESQNQQEKNEQDLLALDGGGSGGSGGSEQKLIS

EEDLGGSGGSGGSNAVGQDTQEVIVVPHSLPFKVVVISAILALVVLTIIS

LIILIMLWQKKPR**
```
Same as BG505_MD39_gp160_dCT_GRSF4.1 but using linker and PDGFR TM domain instead of native TM domain, for better expression. Same as BG505_MD39_gp140-PDGFR but adding 3 glycans at positions 80, 241, 289.

BG505_MD39_gp140-PDGFR_GRSF4.1_m
(SEQ ID NO: 105)
```
AENLWVTVYYGVPVWKDAETTLFCASDAKAYETEKHNVWATHACVPTDPN

SSEIHLENVTEEFNMWKNNMVEQMHEDIISLWDQSLKPCVKLTPLCVTLQ

CTNVTNNITDDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCQNVSTVQCTHGIKPVVSTQLLLNGSLAEEEVIIRSENITNN

AKNILVQLNTSVQINCTRPNNNTVKSIRIGPGQAFYYTGDIIGDIRQAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVSLGFLGAAGSTM

GAASMTLTVQARNLLSGIVQQQSNLLRAPEPQQHLLKDTHWGIKQLQARV

LAVEHYLRDQQLLGIWGCSGKLICCTNVPWNSSWSNRNLSEIWDNMTWLQ

WDKEISNYTQIIYGLLEESQNQQEKNEQDLLALDGGGSGGSGGSEQKLIS

EEDLGGSGGSGGSNAVGQDTQEVIVVPHSLPFKVVVISAILALVVLTIIS

LIILIMLWQKKPR**
```

The second set of Type XII sequences are cleavage-independent, TM-anchored trimers, some with glycan masking.
BG505_MD39_link14 anchored to membrane by linker and PDGFR TM domain BG505_MD39_gp140-PDGFR_link14
(SEQ ID NO: 106)
```
AENLWVTVYYGVPVWKDAETTLFCASDAKAYETEKHNVWATHACVPTDPN

PQEIHLENVTEEFNMWKNNMVEQMHEDIISLWDQSLKPCVKLTPLCVTLQ

CTNVTNNITDDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVIIRSENITNN

AKNILVQLNTPVQINCTRPNNNTVKSIRIGPGQAFYYTGDIIGDIRQAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE
```

LYKYKVVKIEPLGVAPTRCKRRVVGSHSGSGGSGSGGHAAVGIGAVSLGF

LGAAGSTMGAASMTLTVQARNLLSGIVQQQSNLLRAPEPQQHLLKDTHWG

IKQLQARVLAVEHYLRDQQLLGIWGCSGKLICCTNVPWNSSWSNRNLSEI

WDNMTWLQWDKEISNYTQIIYGLLEESQNQQEKNEQDLLALDGGGSGGSG

GSEQKLISEEDLGGSGGSGGSNAVGQDTQEVIVVPHSLPFKVVVISAILA

LVVLTIISLIILIMLWQKKPR**

Cleavage-independent, link14 version of BG505_MD39_gp160_dCT.

BG505_MD39_gp160-dCT_link14
(SEQ ID NO: 107)
AENLWVTVYYGVPVWKDAETTLFCASDAKAYETEKHNVWATHACVPTDPN

PQEIHLENVTEEFNMWKNNMVEQMHEDIISLWDQSLKPCVKLTPLCVTLQ

CTNVTNNITDDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVIIRSENITNN

AKNILVQLNTPVQINCTRPNNNTVKSIRIGPGQAFYYTGDIIGDIRQAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGSHSGSGGSGSGGHAAVGIGAVSLGF

LGAAGSTMGAASMTLTVQARNLLSGIVQQQSNLLRAPEPQQHLLKDTHWG

IKQLQARVLAVEHYLRDQQLLGIWGCSGKLICCTNVPWNSSWSNRNLSEI

WDNMTWLQWDKEISNYTQIIYGLLEESQNQQEKNEQDLLALDKWASLWNW

FDISNWLWYIKIFIMIVGGLIGLRIVFAVLSVIHRVRQGYSPLS**

Same as BG505_MD39_gp160-dCT_link14 but adding 3 glycans, at positions 80, 241, 289.

BG505_MD39_gp160-dCT_link14_GRSF4.1
(SEQ ID NO: 108)
AENLWVTVYYGVPVWKDAETTLFCASDAKAYETEKHNVWATHACVPTDPN

SSEIHLENVTEEFNMWKNNMVEQMHEDIISLWDQSLKPCVKLTPLCVTLQ

CTNVTNNITDDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCQNVSTVQCTHGIKPVVSTQLLLNGSLAEEEVIIRSENITNN

AKNILVQLNTSVQINCTRPNNNTVKSIRIGPGQAFYYTGDIIGDIRQAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGSHSGSGGSGSGGHAAVGIGAVSLGF

LGAAGSTMGAASMTLTVQARNLLSGIVQQQSNLLRAPEPQQHLLKDTHWG

IKQLQARVLAVEHYLRDQQLLGIWGCSGKLICCTNVPWNSSWSNRNLSEI

WDNMTWLQWDKEISNYTQIIYGLLEESQNQQEKNEQDLLALDKWASLWNW

FDISNWLWYIKIFIMIVGGLIGLRIVFAVLSVIHRVRQGYSPLS**

Same as BG505_MD39_gp160-dCT_link14_GRSF4.1 but using linker and PDGFR TM domain instead of native TM domain, for better expression.

BG505_MD39_gp140-PDGFR_link14_GRSF4.1
(SEQ ID NO: 109)
AENLWVTVYYGVPVWKDAETTLFCASDAKAYETEKHNVWATHACVPTDPN

SSEIHLENVTEEFNMWKNNMVEQMHEDIISLWDQSLKPCVKLTPLCVTLQ

CTNVTNNITDDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCQNVSTVQCTHGIKPVVSTQLLLNGSLAEEEVIIRSENITNN

AKNILVQLNTSVQINCTRPNNNTVKSIRIGPGQAFYYTGDIIGDIRQAHC

NVSKATWNETLGKVVKQLRKHFGNNTIIRFAQSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGSHSGSGGSGSGGHAAVGIGAVSLGF

LGAAGSTMGAASMTLTVQARNLLSGIVQQQSNLLRAPEPQQHLLKDTHWG

IKQLQARVLAVEHYLRDQQLLGIWGCSGKLICCTNVPWNSSWSNRNLSEI

WDNMTWLQWDKEISNYTQIIYGLLEESQNQQEKNEQDLLALDGGGSGGSG

GSEQKLISEEDLGGSGGSGGSNAVGQDTQEVIVVPHSLPFKVVVISAILA

LVVLTIISLIILIMLWQKKPR**

BG505_MD39_CP1.2_GRSF4 plus linker and PDGFR TM domain.
Similar to BG505_MD39_gp140-PDGFR_link14_GRSF4.1 but is CP1.2 instead of link14 and GRSF4.0 instead of GRSF4.1

BG505_MD39_gp140-PDGFR_CP1.2_GRSF4.0
(SEQ ID NO: 110)
VSLGFLGAAGSTMGAASMTLTVQARNLLSGIVQQQSNLLRAPEPQQHLLK

DTHWGIKQLQARVLAVEHYLRDQQLLGIWGCSGKLICCTNVPWNSSWSNR

NLSEIWDNMTWLQWDKEISNYTQIIYGLLEESQNQQEKNEQDLGGNGSGG

GSGSGGNGSSGLWVTVYYGVPVWKDAETTLFCASDAKAYETEKHNVWATH

ACVPTDPNSSEIHLENVTEEFNMWKNNMVEQMHEDIISLWDQSLKPCVKL

TPLCVTLQCTNVTNNITDDMRGELKNCSFNMTTELRDKKQKVYSLFYRLD

VVQINENQGNRSNNSNKEYRLINCNTSAITQACPKVSFEPIPIHYCAPAG

FAILKCKDKKFNGTGPCQNVSTVQCTHGIKPVVSTQLLLNGSLAEEEVII

RSENITNNAKNILVQLNTSVQINCTRPNNNTVKSIRIGPGQAFYYTGDII

GDIRQAHCNVSKATWNETLGKVVKQLRKHFGNNTIIRFAQSSGGDLEVIT

HSFNCGGEFFYCNTSGLFNSTWISNTSVQGSNSTGSNDSITLPCRIKQII

NMWQRIGQAMYAPPIQGVIRCVSNITGLILTRDGGSTNSTTETFRPGGGD

```
MRDNWRSELYKYKVVKIEPLGVAPTRCKRRGGGSGGSGGSEQKLISEEDL

GGSGGSGGSNAVGQDTQEVIVVPHSLPFKVVVISAILALVVLTIISLIIL

IMLWQKKPR**
```

\# Different Circular permutation than CP1.2; this one uses native gp41 C-term so might be better for membrane presentation. Indeed, CP2 doesn't need flexible linker to the membrane. This version is gp160 minus the cytoplasmic domain and has additional glycosylation sites added to positions 80, 241, 289.

```
BG505_MD39_gp160-dCT_CP2_GRSF4.1
                                      (SEQ ID NO: 111)
VSLGFLGAAGSTMGAASMTLTVQARNLLSGIVQQQSNLLRAPEPQQHLLK

DTHWGIKQLQARVLAVEHYLRDQQLLGIWGCSGKLICCTGGSGVTVYYGV

PVWKDAETTLFCASDAKAYETEKHNVWATHACVPTDPNSSEIHLENVTEE

FNMWKNNMVEQMHEDIISLWDQSLKPCVKLTPLCVTLQCTNVTNNITDDM

RGELKNCSFNMTTELRDKKQKVYSLFYRLDVVQINENQGNRSNNSNKEYR

LINCNTSAITQACPKVSFEPIPIHYCAPAGFAILKCKDKKFNGTGPCQNV

STVQCTHGIKPVVSTQLLLNGSLAEEEVIIRSENITNNAKNILVQLNTSV

QINCTRPNNNTVKSIRIGPGQAFYYTGDIIGDIRQAHCNVSKATWNETLG

KVVKQLRKHFGNNTIIRFAQSSGGDLEVTTHSFNCGGEFFYCNTSGLFNS

TWISNTSVQGSNSTGSNDSITLPCRIKQIINMWQRIGQAMYAPPIQGVIR

CVSNITGLILTRDGGSTNSTTETFRPGGGDMRDNWRSELYKYKVVKIEPL

GVAPTRCKRGGSGSGVPWNSSWSNRNLSEIWDNMTWLQWDKEISNYTQII

YGLLEESQNQQEKNEQDLLALDKWASLWNWFDISNWLWYIKIFIMIVGGL

IGLRIVFAVLSVIHRVRQGYSPLS**
```

\# BG505_MD39_gp160-dCT_CP2_GRSF4.1 but with two extra glycans (NQSLLALDNGS SEQ ID NO: 165)) and with linker and PDGFR TM instead of native TM.

```
BG505_MD39_gp140-PDGFR_CP2_GRSF4.2
                                      (SEQ ID NO: 112)
VSLGFLGAAGSTMGAASMTLTVQARNLLSGIVQQQSNLLRAPEPQQHLLK

DTHWGIKQLQARVLAVEHYLRDQQLLGIWGCSGKLICCTGGSGVTVYYGV

PVWKDAETTLFCASDAKAYETEKHNVWATHACVPTDPNSSEIHLENVTEE

FNMWKNNMVEQMHEDIISLWDQSLKPCVKLTPLCVTLQCTNVTNNITDDM

RGELKNCSFNMTTELRDKKQKVYSLFYRLDVVQINENQGNRSNNSNKEYR

LINCNTSAITQACPKVSFEPIPIHYCAPAGFAILKCKDKKFNGTGPCQNV

STVQCTHGIKPVVSTQLLLNGSLAEEEVIIRSENITNNAKNILVQLNTSV

QINCTRPNNNTVKSIRIGPGQAFYYTGDIIGDIRQAHCNVSKATWNETLG

KVVKQLRKHFGNNTIIRFAQSSGGDLEVITHSFNCGGEFFYCNTSGLFNS

TWISNTSVQGSNSTGSNDSITLPCRIKQIINMWQRIGQAMYAPPIQGVIR

CVSNITGLILTRDGGSTNSTTETFRPGGGDMRDNWRSELYKYKVVKIEPL

GVAPTRCKRGGSGSGVPWNSSWSNRNLSEIWDNMTWLQWDKEISNYTQII

YGLLEESQNQQEKNNQSLLALDNGSGGGSGGSGGSEQKLISEEDLGGSGG

SGGSNAVGQDTQEVIVVPHSLPFKVVVISAILALVVLTIISLIILIMLWQ

KKPR**
```

\# BG505_MD39_gp160-dCT_CP2_GRSF4.1 but with CT included, so this is full-length gp160.

```
BG505_MD39_gp160_CP2_GRSF4.1
                                      (SEQ ID NO: 113)
VSLGFLGAAGSTMGAASMTLTVQARNLLSGIVQQQSNLLRAPEPQQHLLK

DTHWGIKQLQARVLAVEHYLRDQQLLGIWGCSGKLICCTGGSGVTVYYGV

PVWKDAETTLFCASDAKAYETEKHNVWATHACVPTDPNSSEIHLENVTEE

FNMWKNNMVEQMHEDIISLWDQSLKPCVKLTPLCVTLQCTNVTNNITDDM

RGELKNCSFNMTTELRDKKQKVYSLFYRLDVVQINENQGNRSNNSNKEYR

LINCNTSAITQACPKVSFEPIPIHYCAPAGFAILKCKDKKFNGTGPCQNV

STVQCTHGIKPVVSTQLLLNGSLAEEEVIIRSENITNNAKNILVQLNTSV

QINCTRPNNNTVKSIRIGPGQAFYYTGDIIGDIRQAHCNVSKATWNETLG

KVVKQLRKHFGNNTIIRFAQSSGGDLEVTTHSFNCGGEFFYCNTSGLFNS

TWISNTSVQGSNSTGSNDSITLPCRIKQIINMWQRIGQAMYAPPIQGVIR

CVSNITGLILTRDGGSTNSTTETFRPGGGDMRDNWRSELYKYKVVKIEPL

GVAPTRCKRGGSGSGVPWNSSWSNRNLSEIWDNMTWLQWDKEISNYTQII

YGLLEESQNQQEKNEQDLLALDKWASLWNWFDISNWLWYIKIFIMIVGGL

IGLRIVFAVLSVIHRVRQGYSPLSFQTHTPNPRGLDRPERIEEEDGEQDR

GRSTRLVSGFLALAWDDLRSLCLFCYHRLRDFILIAARIVELLGHSSLKG

LRLGWEGLKYLWNLLAYWGRELKISAINLFDTIAIAVAEWTDRVIEIGQR

LCRAFLHIPRRIRQGLERALL**
```

In one embodiment, the nucleic acids of the present invention may be delivered as a therapeutic mRNA.

Provided herein are isolated nucleic acids (e.g., modified mRNAs encoding a peptide described herein) comprising a translatable region and at least two different nucleoside modifications, wherein the nucleic acid exhibits reduced degradation in a cell into which the nucleic acid is introduced, relative to a corresponding unmodified nucleic acid. For example, the degradation rate of the nucleic acid is reduced by at least 10%, 20%, 30%, 40%, 50%, 60%, 70%, 80%, or 90%, compared to the degradation rate of the corresponding unmodified nucleic acid. In certain embodiments, the nucleic acid comprises RNA, DNA, TNA, GNA, or a hybrid thereof. In certain embodiments, the nucleic acid comprises messenger RNA (mRNA). In certain embodiments, the mRNA does not substantially induce an innate immune response of the cell into which the mRNA is introduced. In certain embodiments, the mRNA comprises at least one nucleoside selected from the group consisting of pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine. In certain embodiments, the mRNA comprises at least one nucleoside selected from the group consisting of 5-aza-cytidine, pseudoisocytidine, 3-methyl-cytidine, N4-acetylcytidine, 5-formyl cytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine. In other embodiments, the mRNA comprises at least one nucleoside selected from the group consisting of 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine. In yet other embodiments, the mRNA comprises at least one nucleoside selected from the group consisting of inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethyl-guanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleic acids provided herein comprise a 5' untranslated region (UTR) and/or a 3'UTR, wherein each of the two different nucleoside modifications are independently present in the 5'UTR and/or 3'UTR. In some embodiments, nucleic acids are provided herein, wherein at least one of the two different nucleoside modifications are present in the translatable region. In some embodiments, nucleic acids provided herein are capable of binding to at least one polypeptide that prevents or reduces an innate immune response of a cell into which the nucleic acid is introduced.

Further provided herein are isolated nucleic acids (e.g., modified mRNAs described herein) comprising (i) a translatable region encoding a peptide described herein, (ii) at least one nucleoside modification, and (iii) at least one intronic nucleotide sequence capable of being excised from the nucleic acid.

Further provided herein are isolated nucleic acids (e.g., modified mRNAs described herein) comprising (i) a translatable region encoding a peptide described herein, (ii) at least two different nucleoside modifications, and (iii) a degradation domain.

Further provided herein are non-enzymatically synthesized nucleic acids (e.g., modified mRNAs described herein) comprising at least one nucleoside modification, and comprising a translatable region encoding a peptide described herein. In certain embodiments, the non-enzymatically synthesized mRNA comprises at least two different nucleoside modifications.

Further provided herein are isolated nucleic acids (e.g., modified mRNAs described herein) comprising a noncoding region and at least one nucleoside modification that reduces an innate immune response of a cell into which the nucleic acid is introduced, wherein the nucleic acid sequesters one or more translational machinery components. In certain embodiments, the isolated nucleic acids comprising a non-coding region and at least one nucleoside modification described herein are provided in an amount effective to reduce protein expression in the cell. In certain embodiments, the translational machinery component is a ribosomal protein or a transfer RNA (tRNA). In certain embodiments, the nucleic acid comprises a small nucleolar RNA (snoRNA), microRNA (miRNA), small interfering RNA (siRNA) or Piwi-interacting RNA (piRNA).

Further provided herein are isolated nucleic acids (e.g., modified mRNAs described herein) comprising (i) a first translatable region, (ii) at least one nucleoside modification, and (iii) an internal ribosome entry site (IRES). In certain embodiments, the IRES is obtained from a picornavirus, a pest virus, a polio virus, an encephalomyocarditis virus, a foot-and-mouth disease virus, a hepatitis C virus, a classical swine fever virus, a murine leukemia virus, a simian immune deficiency virus or a cricket paralysis virus. In certain embodiments, the isolated nucleic acid further comprises a second translatable region. In certain embodiments, the isolated nucleic acid further comprises a Kozak sequence. In some embodiments, the first translatable region encodes a peptide described herein. In some embodiments, the second translatable region encodes peptide described herein. In some embodiments, the first and the second translatable regions encode peptides described herein.

Provided herein are pharmaceutical compositions comprising: (i) an effective amount of a synthetic messenger ribonucleic acid (mRNA) encoding peptide described herein; and (ii) a pharmaceutically acceptable carrier, wherein i) the mRNA comprises pseudouridine, 5' methyl-cytidine, or a combination thereof, or ii) the mRNA does not comprise a substantial amount of a nucleotide or nucleotides selected from the group consisting of uridine, cytidine, and a combination of uridine and cytidine, and wherein the composition is suitable for repeated administration (e.g., intravenous administration) to a mammalian subject in need thereof. In some embodiments, Further provided herein are pharmaceutical compositions comprising and/or consisting essentially of: (i) an effective amount of a synthetic messenger ribonucleic acid (mRNA) encoding peptide described herein; (ii) a cell penetration agent; and (iii) a pharmaceutically acceptable carrier, wherein i) the mRNA comprises pseudouridine, 5' methyl-cytidine or a combination thereof, or ii) the mRNA does not comprise a substantial amount of a nucleotide or nucleotides selected from the group consisting of uridine, cytidine, and a combination of uridine and cytidine, and wherein the composition is suitable for repeated administration (e.g., intravenous administration) to an animal (e.g., mammalian) subject in need thereof.

This invention provides nucleic acids, including RNAs such as mRNAs that contain one or more modified nucleosides (termed "modified nucleic acids"), which have useful properties including the lack of a substantial induction of the innate immune response of a cell into which the mRNA is introduced. Because these modified nucleic acids enhance the efficiency of protein production, intracellular retention of nucleic acids, and viability of contacted cells, as well as possess reduced immunogenicity, these nucleic acids having these properties are termed "enhanced nucleic acids" herein.

The term "nucleic acid," in its broadest sense, includes any compound and/or substance that is or can be incorporated into an oligonucleotide chain. Exemplary nucleic acids for use in accordance with the present invention include, but are not limited to, one or more of DNA, RNA, hybrids thereof, RNAi-inducing agents, RNAi agents, siRNAs, shRNAs, miRNAs, antisense RNAs, ribozymes, catalytic DNA, RNAs that induce triple helix formation, aptamers, vectors, etc., described in detail herein.

Provided are modified nucleic acids containing a translatable region encoding a peptide described herein, and one, two, or more than two different nucleoside modifications. In some embodiments, the modified nucleic acid exhibits reduced degradation in a cell into which the nucleic acid is introduced, relative to a corresponding unmodified nucleic acid. For example, the degradation rate of the nucleic acid is reduced by at least 10%, 20%, 30%, 40%, 50%, 60%, 70%, 80%, or 90%, compared to the degradation rate of the corresponding unmodified nucleic acid. Exemplary nucleic acids include ribonucleic acids (RNAs), deoxyribonucleic acids (DNAs), threose nucleic acids (TNAs), glycol nucleic acids (GNAs), peptide nucleic acids (PNAs), locked nucleic acids (LNAs) or a hybrid thereof. In preferred embodiments, the modified nucleic acid includes messenger RNAs (mRNAs). As described herein, the nucleic acids of the invention do not substantially induce an innate immune response of a cell into which the mRNA is introduced.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethyl cytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In certain embodiments it is desirable to intracellularly degrade a modified nucleic acid introduced into the cell, for example if precise timing of protein production is desired. Thus, the invention provides a modified nucleic acid containing a degradation domain, which is capable of being acted on in a directed manner within a cell.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

Other components of nucleic acid are optional, and are beneficial in some embodiments. For example, a 5' untranslated region (UTR) and/or a 3'UTR are provided, wherein either or both may independently contain one or more different nucleoside modifications. In such embodiments, nucleoside modifications may also be present in the translatable region. Also provided are nucleic acids containing a Kozak sequence.

Further, nucleic acids encoding a peptide described herein, and containing an internal ribosome entry site (IRES) are provided herein. An IRES may act as the sole ribosome binding site, or may serve as one of multiple ribosome binding sites of an mRNA. An mRNA containing more than one functional ribosome binding site may encode several peptides or polypeptides that are translated independently by the ribosomes ("multicistronic mRNA"). When nucleic acids are provided with an IRES, further optionally provided is a second translatable region. Examples of IRES sequences that can be used according to the invention include without limitation, those from picornaviruses (e.g., FMDV), pest viruses (CFFV), polio viruses (PV), encephalomyocarditis viruses (ECMV), foot-and-mouth disease viruses (FMDV), hepatitis C viruses (HCV), classical swine fever viruses (CSFV), murine leukemia virus (MLV), simian immune deficiency viruses (SIV) or cricket paralysis viruses (CrPV).

The therapeutic mRNAs as described, for example, in U.S. Pat. Nos. 9,464,124; 9,447,164; 9,428,535; 9,334,328; 9,303,079; 9,301,993; 9,295,689; 9,283,287; 9,271,996; 9,255,129; 9,254,311; 9,233,141; 9,221,891; 9,220,792; 9,220,755; 9,216,205; 9,192,651; 9,186,372; 9,181,319; 9,149,506; 9,114,113; 9,107,886; 9,095,552; 9,089,604; 9,061,059; 9,050,297; 8,999,380; 8,980,864; 8,822,663; 8,754,062; 8,710,200; 8,680,069 and 8,664,194 may be utilized for the present invention.

Methods for the chemical conjugation of polypeptides, carbohydrates, and/or lipids are well known in the art (see, for example, Hermanson. Bioconjugate Techniques (Academic Press; 1992); Aslam and Dent, eds. Bioconjugation: Protein coupling Techniques for the Biomedical Sciences (MacMillan: 1998); and Wong Chemistry of Protein Conjugation and Cross-linking (CRC Press: 1991)). For instance, primary amino groups may be incorporated by reaction with ethylenediamine in the presence of sodium cyanoborohydride and sulfhydryls may be introduced by reaction of cysteamin dihydrochloride followed by reduction with a standard disulfide reducing agent. Heterobifunctional crosslinkers, such as, for example, sulfosuccinimidyl (4-iodoacetyl) aminobenzoate, which link the epsilon amino group on the D-lysine residues of copolymers of D-lysine and D-glutamate to a sulfhydryl side chain from an amino terminal cysteine residue on the peptide to be coupled, may be used as well. Chemical conjugation also includes anything covalently bonded directly via side chain bonds or via a linker or spacer group.

The nanoparticle formulations may be a carbohydrate nanoparticle comprising a carbohydrate carrier and a modified nucleic acid molecule (e.g., mmRNA). As a non-limiting example, the carbohydrate carrier may include, but is not limited to, an anhydride-modified phytoglycogen or glycogen-type material, phtoglycogen octenyl succinate, phytoglycogen beta-dextrin, anhydride-modified phytoglycogen beta-dextrin. (See e.g., International Publication No. WO2012109121; herein incorporated by reference in its entirety).

Lipid nanoparticle formulations may be improved by replacing the cationic lipid with a biodegradable cationic lipid which is known as a rapidly eliminated lipid nanoparticle (reLNP). Ionizable cationic lipids, such as, but not limited to, DLinDMA, DLin-KC2-DMA, and DLin-MC3-DMA, have been shown to accumulate in plasma and tissues over time and may be a potential source of toxicity. The rapid metabolism of the rapidly eliminated lipids can improve the tolerability and therapeutic index of the lipid nanoparticles by an order of magnitude from a 1 mg/kg dose to a 10 mg/kg dose in rat. Inclusion of an enzymatically degraded ester linkage can improve the degradation and metabolism profile of the cationic component, while still maintaining the activity of the reLNP formulation. The ester linkage can be internally located within the lipid chain or it may be terminally located at the terminal end of the lipid chain. The internal ester linkage may replace any carbon in the lipid chain.

The average diameter of the nanoparticle employed in the compositions of the invention can be at least one member selected from the group consisting of about 20 nanometers, about 25 nanometers, about 30 nanometers, about 40 nanometers, about 50 nanometers, about 75 nanometers, about 100 nanometers, about 125 nanometers, about 150 nanometers, about 175 nanometers and about 200 nanometers. In another embodiment, the average diameter of the particle is at least one member selected from the group consisting of between about 10 to about 200 nanometers, between about 0.5 to about 5 microns and between about 5 to about 10 microns. In another embodiment, the average diameter of the microparticle is selected from the group consisting of about 0.1 m, about 0.2 m, about 0.4 m, about 0.5 m, about 1 m and about 2 m.

Nanoparticles for use in the compositions of the invention can be made from lipids or other fatty acids (see, for example, U.S. Pat. Nos. 5,709,879; 6,342,226; 6,090,406; Lian, et al., J. of Pharma. Sci. 90:667-680 (2001) and van Slooten, et al., Pharm Res. 17:42-48 (2000)) and non-lipid compositions (see, for example, Kreuter, J. Anat. 189:503-505 (1996), the teachings of all of which are hereby incorporated by reference in their entirety). The compositions can be bilayer or multilamellar liposomes and phospholipid based. Polymerized nanoparticles, as described, for example, in U.S. Pat. No. 7,285,289, the teachings of which are incorporated by reference in their entirety.

Metallic oxide nanoparticles for use in the compositions of the invention can be chemically substituted with at least one reactive moiety capable of forming a thioether bond employing conventionally techniques as described herein and in U.S. Pat. No. 6,086,881, the teachings of which are hereby incorporated by reference in their entirety. The antigen described herein can be coupled in a single step onto the metallic oxide particles by the formation of at least one thioether bond or it may be synthesized or assembled stepwise onto the metallic oxide particles after the initial thioether bond formation. The chemical derivatization reagents for the metallic oxide particles can include organosilane reagents that provide thioalkane functionality or other groups that may readily be converted into thiols or thiol-reactive moieties. Organosilane reagents which may be utilized for this purpose may be, but are not limited to, 3-mercaptopropyltrimethoxysilane, 3-aminopropyltriethoxysilane, 3-iodopropyltrimethoxysilane, 2-chloroethyltrichlorosilane, 3-glycidoxypropyltrimethoxysilane, vinyltrichlorosilane and 3-acryloxypropyltrimethoxysilane. Moieties that include one or more disulfide components may also be joined to the metallic oxide particle surface and thereby provide the corresponding reactive moiety able to enter into and form a thioether bond and juncture. Exemplary nanoparticles for use in the compositions of the invention include at least one member selected from the group consisting of poly (d,l-lactide-co-glycolide, also referred to as "poly(lactic-co-glycolic acid) and bisacyloxypropylcysteine.

Nanoparticles for use in the compositions of the invention can be made of inorganic material. Nanoparticles for use in the compositions of the invention can be made of a polymer material, such as at least one member selected from the group consisting of polystyrene, brominated polystyrene, polyacrylic acid, polyacrylonitrile, polyamide, polyacrylamide, polyacrolein, polybutadiene, polycaprolactone, polycarbonate, polyester, polyethylene, polyethylene terephthalate, polydimethylsiloxane, polyisoprene, polyurethane, polyvinylacetate, polyvinylchloride, polyvinylpyridine, polyvinylbenzylchloride, polyvinyltoluene, polyvinylidene chloride, polydivinylbenzene, polymethylmethacrylate, polylactide, polyglycolide, poly(lactide-co-glycolide), polyanhydride, polyorthoester, polyphosphazene, polyphosophaze, a carbohydrate, carboxymethyl cellulose, hydroxyethyl cellulose, agar, gel, proteinaceous polymer, polypeptide, eukaryotic and prokaryotic cells, viruses, lipid, metal, resin, latex, rubber, silicone (e.g., polydimethyldiphenyl siloxane), glass, ceramic, charcoal, kaolinite and bentonite.

It is noted that these therapeutics may be a chemical compound, a composition which may comprise a polypeptide of the present invention and/or antibody elicited by such a chemical compound and/or portion thereof or a pharmaceutically acceptable salt or a composition which may comprise a polypeptide of the invention, and may be administered alone or as an active ingredient in combination with pharmaceutically acceptable carriers, diluents, and vehicles, as well as other active ingredients.

The compounds or compositions may be administered orally, subcutaneously or parenterally including intravenous, intraarterial, intramuscular, intraperitoneally, and intranasal administration as well as intrathecal and infusion techniques.

It is noted that humans are treated generally longer than the mice or other experimental animals which treatment has a length proportional to the length of the disease process and drug effectiveness. The doses may be single doses or multiple doses over a period of several days, but single doses are preferred. Thus, one may scale up from animal experiments, e.g., rats, mice, and the like, to humans, by techniques from this disclosure and documents cited herein and the knowledge in the art, without undue experimentation.

The treatment generally has a length proportional to the length of the disease process and drug effectiveness and the patient being treated.

When administering a therapeutic of the present invention parenterally, it will generally be formulated in a unit dosage injectable form (solution, suspension, emulsion). The pharmaceutical formulations suitable for injection include sterile aqueous solutions or dispersions and sterile powders for reconstitution into sterile injectable solutions or dispersions. The carrier may be a solvent or dispersing medium containing, for example, water, ethanol, polyol (for example, glycerol, propylene glycol, liquid polyethylene glycol, and the like), suitable mixtures thereof, and vegetable oils.

Proper fluidity may be maintained, for example, by the use of a coating such as lecithin, by the maintenance of the required particle size in the case of dispersion and by the use of surfactants. Nonaqueous vehicles such a cottonseed oil, sesame oil, olive oil, soybean oil, corn oil, sunflower oil, or peanut oil and esters, such as isopropyl myristate, may also be used as solvent systems for compound compositions.

Additionally, various additives which enhance the stability, sterility, and isotonicity of the compositions, including antimicrobial preservatives, antioxidants, chelating agents, and buffers, may be added. Prevention of the action of microorganisms may be ensured by various antibacterial and antifungal agents, for example, parabens, chlorobutanol, phenol, sorbic acid, and the like. In many cases, it will be desirable to include isotonic agents, for example, sugars, sodium chloride, and the like. Prolonged absorption of the injectable pharmaceutical form may be brought about by the use of agents delaying absorption, for example, aluminum monostearate and gelatin. According to the present invention, however, any vehicle, diluent, or additive used would have to be compatible with the compounds.

Sterile injectable solutions may be prepared by incorporating the compounds utilized in practicing the present invention in the required amount of the appropriate solvent with various amounts of the other ingredients, as desired.

A pharmacological formulation of the present invention, e.g., which may comprise a therapeutic compound or polypeptide of the present invention, may be administered to the patient in an injectable formulation containing any compatible carrier, such as various vehicles, adjuvants, additives, and diluents; or the compounds utilized in the present invention may be administered parenterally to the patient in the form of slow-release subcutaneous implants or targeted delivery systems such as monoclonal antibodies, iontophoretic, polymer matrices, liposomes, and microspheres.

A pharmacological formulation of the compound and composition which may comprise a polypeptide utilized in the present invention may be administered orally to the patient. Conventional methods such as administering the compounds in tablets, suspensions, solutions, emulsions, capsules, powders, syrups and the like are usable. Known techniques, which deliver the compound orally or intravenously and retain the biological activity, are preferred.

In one embodiment, a formulation of the present invention may be administered initially, and thereafter maintained by further administration. For instance, a formulation of the invention may be administered in one type of composition and thereafter further administered in a different or the same type of composition. For example, a formulation of the invention may be administered by intravenous injection to bring blood levels to a suitable level. The patient's levels are then maintained by an oral dosage form, although other forms of administration, dependent upon the patient's condition, may be used. In the instance of a vaccine composition, the vaccine may be administered as a single dose, or the vaccine may incorporate set booster doses. For example, booster doses may comprise variants in order to provide protection against multiple clades of HIV.

The quantity to be administered will vary for the patient being treated and whether the administration is for treatment or prevention and will vary from a few micrograms to a few milligrams for an average 70 kg patient, e.g., 5 micrograms to 5 milligrams such as 500 micrograms, or about 100 ng/kg of body weight to 100 mg/kg of body weight per administration and preferably will be from 10 pg/kg to 10 mg/kg per administration. Typically, however, the antigen is present in an amount on, the order of micrograms to milligrams, or, about 0.001 to about 20 wt %, preferably about 0.01 to about 10 wt %, and most preferably about 0.05 to about 5 wt %.

Of course, for any composition to be administered to an animal or human, including the components thereof, and for any particular method of administration, it is preferred to determine therefor: toxicity, such as by determining the lethal dose (LD) and $LD_{50}$ in a suitable animal model e.g., rodent such as mouse; and, the dosage of the composition(s), concentration of components therein and timing of administering the composition(s), which elicit a suitable immunological response, such as by titrations of sera and analysis thereof for antibodies or antigens, e.g., by ELISA and/or RFFIT analysis. Such determinations do not require undue experimentation from the knowledge of the skilled artisan, this disclosure and the documents cited herein. And, the time for sequential administrations may be ascertained without undue experimentation. For instance, dosages may be readily ascertained by those skilled in the art from this disclosure and the knowledge in the art. Thus, the skilled artisan may readily determine the amount of compound and optional additives, vehicles, and/or carrier in compositions and to be administered in methods of the invention. Typically, an adjuvant or additive is commonly used as 0.001 to 50 wt % solution in phosphate buffered saline, and the active ingredient is present in the order of micrograms to milligrams, such as about 0.0001 to about 5 wt %, preferably about 0.0001 to about 1 wt %, most preferably about 0.0001 to about 0.05 wt % or about 0.001 to about 20 wt %, preferably about 0.01 to about 10 wt %, and most preferably about 0.05 to about 5 wt %. Such determinations do not require undue experimentation from the knowledge of the skilled artisan, this disclosure and the documents cited herein. And, the time for sequential administrations may be ascertained without undue experimentation.

Examples of compositions which may comprise a therapeutic of the invention include liquid preparations for orifice, e.g., oral, nasal, anal, vaginal, peroral, intragastric, mucosal (e.g., perlingual, alveolar, gingival, olfactory or respiratory mucosa) etc., administration such as suspensions, syrups or elixirs; and, preparations for parenteral, subcutaneous, intradermal, intramuscular or intravenous administration (e.g., injectable administration), such as sterile suspensions or emulsions. Such compositions may be in admixture with a suitable carrier, diluent, or excipient such as sterile water, physiological saline, glucose or the like. The compositions may also be lyophilized. The compositions may contain auxiliary substances such as wetting or emulsifying agents, pH buffering agents, gelling or viscosity enhancing additives, preservatives, flavoring agents, colors, and the like, depending upon the route of administration and the preparation desired. Standard texts, such as "REMINGTON'S PHARMACEUTICAL SCIENCE", 17th edition, 1985, incorporated herein by reference, may be consulted to prepare suitable preparations, without undue experimentation.

Compositions of the invention, are conveniently provided as liquid preparations, e.g., isotonic aqueous solutions, suspensions, emulsions or viscous compositions which may be buffered to a selected pH. If digestive tract absorption is preferred, compositions of the invention may be in the "solid" form of pills, tablets, capsules, caplets and the like, including "solid" preparations which are time-released or which have a liquid filling, e.g., gelatin covered liquid, whereby the gelatin is dissolved in the stomach for delivery to the gut. If nasal or respiratory (mucosal) administration is desired, compositions may be in a form and dispensed by a squeeze spray dispenser, pump dispenser or aerosol dispenser. Aerosols are usually under pressure by means of a hydrocarbon. Pump dispensers may preferably dispense a metered dose or, a dose having a particular particle size.

Compositions of the invention may contain pharmaceutically acceptable flavors and/or colors for rendering them more appealing, especially if they are administered orally. The viscous compositions may be in the form of gels, lotions, ointments, creams and the like (e.g., for transdermal administration) and will typically contain a sufficient amount of a thickening agent so that the viscosity is from about 2500 to 6500 cps, although more viscous compositions, even up to 10,000 cps may be employed. Viscous compositions have a viscosity preferably of 2500 to 5000 cps, since above that range they become more difficult to administer. However, above that range, the compositions may approach solid or gelatin forms, which are then easily administered as a swallowed pill for oral ingestion.

Liquid preparations are normally easier to prepare than gels, other viscous compositions, and solid compositions. Additionally, liquid compositions are somewhat more convenient to administer, especially by injection or orally. Viscous compositions, on the other hand, may be formulated within the appropriate viscosity range to provide longer contact periods with mucosa, such as the lining of the stomach or nasal mucosa.

Obviously, the choice of suitable carriers and other additives will depend on the exact route of administration and the nature of the particular dosage form, e.g., liquid dosage form (e.g., whether the composition is to be formulated into a solution, a suspension, gel or another liquid form), or solid dosage form (e.g., whether the composition is to be formulated into a pill, tablet, capsule, caplet, time release form or liquid-filled form).

Solutions, suspensions and gels, normally contain a major amount of water (preferably purified water) in addition to the active compound. Minor amounts of other ingredients such as pH adjusters (e.g., a base such as NaOH), emulsifiers or dispersing agents, buffering agents, preservatives, wetting agents, jelling agents, (e.g., methylcellulose), colors and/or flavors may also be present. The compositions may be isotonic, i.e., it may have the same osmotic pressure as blood and lacrimal fluid.

The desired isotonicity of the compositions of this invention may be accomplished using sodium chloride, or other pharmaceutically acceptable agents such as dextrose, boric acid, sodium tartrate, propylene glycol or other inorganic or organic solutes. Sodium chloride is preferred particularly for buffers containing sodium ions.

Viscosity of the compositions may be maintained at the selected level using a pharmaceutically acceptable thickening agent. Methylcellulose is preferred because it is readily and economically available and is easy to work with. Other suitable thickening agents include, for example, xanthan gum, carboxymethyl cellulose, hydroxypropyl cellulose, carbomer, and the like. The preferred concentration of the thickener will depend upon the agent selected. The important point is to use an amount that will achieve the selected viscosity. Viscous compositions are normally prepared from solutions by the addition of such thickening agents.

A pharmaceutically acceptable preservative may be employed to increase the shelf-life of the compositions. Benzyl alcohol may be suitable, although a variety of preservatives including, for example, parabens, thimerosal, chlorobutanol, or benzalkonium chloride may also be employed. A suitable concentration of the preservative will be from 0.02% to 2% based on the total weight although there may be appreciable variation depending upon the agent selected.

Those skilled in the art will recognize that the components of the compositions should be selected to be chemically inert with respect to the active compound. This will present no problem to those skilled in chemical and pharmaceutical principles, or problems may be readily avoided by reference to standard texts or by simple experiments (not involving undue experimentation), from this disclosure and the documents cited herein.

It is generally envisaged that compounds and compositions of the invention will be administered by injection, as such compounds are to elicit anti-HIV antibodies, and the skilled artisan may, from this disclosure and the knowledge in the art, formulate compounds and compositions identified by herein methods for administration by injection and administer such compounds and compositions by injection.

The inventive compositions of this invention are prepared by mixing the ingredients following generally accepted procedures. For example the selected components may be simply mixed in a blender, or other standard device to produce a concentrated mixture which may then be adjusted to the final concentration and viscosity by the addition of water or thickening agent and possibly a buffer to control pH or an additional solute to control tonicity. Generally the pH may be from about 3 to 7.5. Compositions may be administered in dosages and by techniques well known to those skilled in the medical arts taking into consideration such factors as the age, sex, weight, and condition of the particular patient, and the composition form used for administration (e.g., solid vs. liquid). Dosages for humans or other mammals may be determined without undue experimentation by the skilled artisan, from this disclosure, the documents cited herein, and the knowledge in the art.

Suitable regimes for initial administration and further doses or for sequential administrations also are variable, may include an initial administration followed by subsequent administrations; but nonetheless, may be ascertained by the skilled artisan, from this disclosure, the documents cited herein, and the knowledge in the art.

The present invention will be further illustrated in the following Examples which are given for illustration purposes only and are not intended to limit the invention in any way.

EXAMPLES

Example 1: HIV Vaccine Design to Target Germline Precursors of Glycan-Dependent Broadly Neutralizing Antibodies See Steichen et al., Immunity Volume 45, Issue 3, 20 Sep. 2016, Pages 483-496, the disclosure of which is incorporated by reference.

Broadly neutralizing antibodies (bnAbs) against the N332 supersite of the HIV Envelope (Env) trimer are the most common bnAbs induced during infection, making them promising leads for vaccine design. Wild-type Env glycoproteins lack detectable affinity for supersite-bnAb germline precursors and are therefore unsuitable immunogens to prime supersite-bnAb responses. Applicants employed mammalian cell surface display to design stabilized Env trimers with affinity for germline-reverted precursors of PGT121-class supersite bnAbs. The trimers maintained native-like antigenicity and structure, activated PGT121 inferred-germline B cells ex vivo when multimerized on liposomes, and primed PGT121-like responses in PGT121 inferred-germline knock-in mice. Design intermediates have levels of epitope modification between wild-type and germline-targeting trimers; their mutation gradient suggests sequential immunization to induce bnAbs, in which the germline-targeting prime is followed by progressively less-mutated design intermediates and lastly with native trimers. The vaccine design strategies described could be utilized to target other epitopes on HIV or other pathogens.

A vaccine is needed for global HIV prevention. Broadly neutralizing antibodies (bnAbs) directed against relatively conserved epitopes in the otherwise highly antigenically variable HIV Envelope (Env) glycoprotein trimer offer important guides for vaccine design. BnAbs have been isolated from a small minority of HIV-infected individuals and have been shown to protect against challenge in various animal models, but have not been induced by vaccination in humans or standard animal models (Burton and Hangartner, 2016; Mascola and Haynes, 2013; West et al., 2014). BnAbs recovered from natural infection are typically highly mutated (Klein et al., 2013a; Mouquet et al., 2010; Pancera et al., 2010; Scheid et al., 2009; Walker et al., 2011; Xiao et al., 2009; Zhou et al., 2010) and many also contain insertions and/or deletions (Kepler et al., 2014), owing to chronic stimulation of B cells by mutating Env. Many bnAbs also possess unusually long or short heavy chain complementarity determining region 3 loops (Scheid et al., 2011; Walker et al., 2011; Walker et al., 2009; Wu et al., 2011; Zhou et al., 2010), and some are polyreactive (Haynes et al., 2005). Less mutated bnAbs with fewer unusual features have been engineered, offering more tractable goals for consistent vaccine elicitation (Georgiev et al., 2014; Jardine et al., 2016b; Sok et al., 2013). Overall, bnAb elicitation by vaccination presents a major challenge.

Recombinant native-like trimers are promising HIV vaccine components because they contain the conformational epitopes of most known bnAbs and lack many non-neutralizing epitopes present on less native constructs (Julien et al., 2013; Kong et al., 2016; Kwon et al., 2015; Lyumkis et al., 2013; Pancera et al., 2014; Sanders et al., 2013; Scharf et al., 2015). However, native-like trimers have features that may impede bnAb induction: they are highly glycosylated and expose both strain-specific neutralizing epitopes and non-neutralizing epitopes. Immunization with native-like trimers in standard mouse, rabbit and macaque models has thus far elicited either non-neutralizing antibodies (Hu et al., 2015) or neutralizing antibodies only against the immunogen strain (de Taeye et al., 2016; Sanders et al., 2015) analogous to the strain-specific responses to the seasonal flu vaccine in humans. Induction of HIV bnAbs will likely require development of vaccination strategies that focus responses to relatively conserved, sub-dominant epitopes and avoid or suppress responses to non-neutralizing and strain-specific epitopes.

Germline targeting, a vaccine priming strategy to initiate the affinity maturation of select germline-precursor B cells, could help solve this immunofocusing problem by preferentially activating bnAb precursors (Dimitrov, 2010; Xiao et al., 2009). The strategy aims to activate bnAb-precursor B cells, induce productive (bnAb-like) somatic mutations, and produce memory B cells that can be boosted subsequently to select additional productive mutations (Dosenovic et al., 2015; Jardine et al., 2015). For some bnAbs, inferred precursors have affinity for Env from particular HIV isolates (Andrabi et al., 2015; Doria-Rose et al., 2014; Gorman et al., 2016; Liao et al., 2013), facilitating design of priming immunogens based on Env from those isolates (Haynes et al., 2012). For other bnAbs, efforts to identify wild-type Env that bind inferred precursors have failed (Hoot et al., 2013; Jardine et al., 2013; McGuire et al., 2013; Scheid et al., 2011; Xiao et al., 2009; Zhou et al., 2010). These latter cases require design of modified Env to serve as a priming immunogen (Dimitrov, 2010; Pancera et al., 2010; Xiao et al., 2009; Zhou et al., 2010). Proof of principle that designed germline-targeting immunogens can activate their intended precursors and generate a potentially boostable memory response was recently demonstrated in knock-in mice with B cell precursors for VRC01-class bnAbs directed to the CD4-binding site (Dosenovic et al., 2015; Jardine et al., 2015; McGuire et al., 2016). Following a germline-targeting prime, induction of bnAbs is expected to require a succession of boosts, driving a succession of germinal center reactions, in order to select sufficient mutations (Dimitrov, 2010; Dosenovic et al., 2015; Haynes et al., 2012; Jardine et al., 2013; 2015; 2016b; Klein et al., 2013b; Liao et al., 2013; McGuire et al., 2013; 2016; Pancera et al., 2010; Wu et al., 2011; Xiao et al., 2009; Zhou et al., 2010). Supporting the concept that sequential immunization with different immunogens will be required to develop a bnAb response, native-like trimers but not germline-targeting immunogens were found to boost near-bnAb B cells (bearing a mature VRC01-class bnAb heavy chain) to induce bnAbs (Dosenovic et al., 2015).

Glycan-dependent bnAbs in general, and N332-supersite bnAbs in particular, are important targets for germline-targeting vaccine design. In a recent longitudinal study of HIV infection in Africa, more than half of the HIV-infected individuals who produced bnAb responses produced them against glycan-directed epitopes, the majority of which were within the N332 supersite (Landais et al., 2016). The prevalence of N332-supersite bnAb responses is probably due in part to the high accessibility of their epitopes on top of the trimer.

Among N332-supersite bnAbs, PGT121-class bnAbs have been particularly well characterized, providing strong rationale for germline-targeting efforts. PGT121-class bnAbs are among the most potent bnAbs (Mouquet et al., 2012; Walker et al., 2011), and PGT121 delivered passively to macaques protects against SHIV infection (Moldt et al., 2012; Shingai et al., 2014) and can suppress viremia when delivered after infection (Barouch et al., 2013; Shingai et al., 2013). However, PGT121-class inferred precursors show no measureable affinity for wild-type Env proteins that have been evaluated (Mouquet et al., 2012; Sok et al., 2013). Thus, development of a priming immunogen for PGT121-class precursors requires either design of a modified Env or identification of a natural Env with PGT121-class germline-binding capacity. Crystal structures have been determined for several PGT121-class bnAbs in complex with either BG505 SOSIP native-like trimers or gp120 (Garces et al., 2015; Garces et al., 2014; Julien et al., 2013; Kong et al., 2016; Pancera et al., 2014), and for unliganded structures of two germline-reverted PGT121 variants (Mouquet et al., 2012; Sok et al., 2013), providing critical information to guide design of modified Env for PGT121-class germline-targeting.

PGT121-class bnAbs interact with conformationally flexible structures on HIV Env, including several glycans and the V1 variable loop, making computational design of germline-targeting Env challenging. Here, Applicants developed a structure-guided directed evolution approach, using mammalian cell surface display, to design PGT121-class germline-targeting stabilized-trimer immunogens. Applicants multimerized these trimers on liposomes, and evaluated trimer and liposome immunogens by biophysical, structural, and ex vivo B cell activation analyses. Applicants further evaluated germline-targeting trimers by vaccination in PGT121 inferred-germline knock-in mice. Applicants' design process produced design intermediates with increasing levels of epitope modification between wild-type and germline-targeting trimers. These results led to Applicants' hypothesizing prime-boosting strategies in which a germline-targeting prime is followed by boosts with progressively less-modified design intermediates and then with wild-type Env followed ultimately by a cocktail of Env variants to expand breadth. Evaluation of several of these prime-boosting strategies in PGT121 germline and chimeric knock-in mice is described in a related study (Escolano et al., 2016).

Design of Germline-Targeting Gp120s.

Applicants identified mammalian cell surface display as a desirable platform for engineering modified HIV Env constructs with affinity for inferred-germline PGT121 Abs, as it should allow for optimization of monomeric or multimeric antigens bearing mammalian glycans (Chen et al., 2008). Therefore, Applicants developed a lentivirus-based mammalian cell surface display method to carry out directed evolution of HIV gp120 monomers and gp140 trimers (FIG. 9). Structural analysis of the PGT121 interaction with gp120 (Julien et al., 2013; Pancera et al., 2014) led us to hypothesize that the V1 and V3 loops were the key sites for germline-targeting mutations. For selection agents, Applicants assembled a collection of six germline-reverted Abs, all using heavy chain genes VH4-59, D3-3 and J6 and light chain genes V3-21 and J3, with varying degrees of mutation in the D gene and L-CDR3 and with differences in the non-templated regions at the V-D and D-J boundaries (FIG. 10). Ranked by similarity to the germline D and L3 sequences, these Abs are: $GL_{CDR3rev1}$ (most similar to germline D/L3), $GL_{CDR3rev2}$, $GL_{CDR3rev3}$, $GL_{CDR3rev4}$, $GL_{CDR3rev5}$, and $GL_{CDR3mat}$ (germline V and J genes but mature CDR3 loops). Applicants began by screening libraries based on BG505 T332N gp120 and BG505 SOSIP T332N gp140 (Sanders et al., 2013) in which the conserved glycosylation site at position 332 absent in BG505 was introduced (FIG. 6A). These molecules had no detectable affinity for germline-reverted PGT121 Abs (FIG. 6B and Table 1). Therefore, Applicants employed a "boot-strapping" approach: for initial screening Applicants utilized two variants of $GL_{CDR3mat}$, one with nine PGT121 light chain mutations (GL+9, with 28 µM affinity for BG505 T332N gp120) and another with three light chain mutations (GL+3, no detectable affinity for BG505 T332N gp120) (FIG. 10). Screening a gp120 random mutagenesis library for binding to GL+9 led to the molecule 3MUT, with mutations T135A and T139I to eliminate the V1 loop glycosylation sites at positions 133 and 137 (FIG. 6A). Screening a gp140 structure-guided V1 loop library for binding to GL+3 led to the isolation of 5MUT, with four different mutations (V134Y, N136P, I138L, D140N) in the V1 loop. Combining the mutations in 3MUT and 5MUT produced 7MUT gp120, Applicants' first construct with quantifiable affinity for $GL_{CDR3mat}$ ($K_D$=44 µM, FIGS. 6A and 6B). To improve this affinity further, Applicants screened a gp120 V1 and V3 loop saturation mutagenesis library for binding to $GL_{CDR3mat}$; combining the most enriched mutations (N137F, T320F, Q328M) with 7MUT produced 10MUT, with $K_D \approx 1$ µM for $GL_{CDR3mat}$ (FIGS. 6A and 6B). Finally, to increase affinity and breadth, Applicants screened a gp120 V1 loop directed mutagenesis library for binding to $GL_{CDR3rev2}$ and $GL_{CDR3rev4}$ (FIG. 10). This approach culminated in $11MUT_B$, with $K_D$s of ~5 µM, ~3 µM and ~8 µM for $GL_{CDR3rev1}$, $GL_{CDR3rev3}$ and $GL_{CDR3rev5}$, respectively, and detectable but not quantifiable binding to $GL_{CDR3rev4}$ (FIGS. 6A, 11, and Table 1). Thus, mammalian display-directed evolution enabled the design of germline-targeting gp120 molecules with appreciable affinity for PGT121 germline-reverted antibodies.

Design of Stabilized and Germline-Targeting Trimers.

For initial design of germline-targeting and boosting trimers, Applicants transferred the germline-targeting mutations from the gp120 versions of 3MUT, 5MUT, 7MUT and 10MUT onto the BG505 SOSIP trimer platform. These molecules displayed characteristics of native-like trimers, such as high affinity for the trimer-specific bnAb PGT151 (Falkowska et al., 2014) and a melting temperature ($T_m$) similar to BG505 SOSIP (FIG. 7A). Furthermore, all had similar monovalent affinities for PGT121 and $GL_{CDR3mat}$ as their gp120 counterparts (FIG. 7A), indicating that the germline-targeting mutations were transferable to a native-like trimer.

In addition to binding bnAb putative precursors, germline-targeting trimers should have an otherwise native-like antigenic profile, with high affinity for bnAbs and no significant affinity for non-neutralizing antibodies directed to epitopes exposed on monomeric gp120 but buried or conformationally absent on the trimer. BG505 SOSIP gp140, the trimer on which Applicants' PGT121-class germline-targeting designs were based, displays undesirable binding to V3 non-neutralizing antibodies (Sanders et al., 2013) (FIGS. 7B and 12) and induces non-neutralizing V3 responses in mice, rabbits, and macaques (de Taeye et al., 2016; Hu et al., 2015; Sanders et al., 2015), indicating that this trimer samples conformational states that expose non-neutralizing epitopes. Furthermore, BG505 SOSIP gp140 displayed on mammalian cells via a PDGFR linker showed strong binding to trimer-structure-dependent bnAbs (PGT151 and PGT145) (Falkowska et al., 2014; Walker et al., 2011) but also to non-neutralizing antibodies directed to the V3 loop (4025) (Gorny et al., 2011) and the CD4-binding site (b6) (Barbas et al., 1992) (not shown), suggesting the coexistence on the cell surface of native-like trimers along with non-native trimers, dimers and/or monomers. Applicants also found that adding germline-targeting mutations to BG505 SOSIP reduced the already-modest expression by 50% (FIG. 7A). Therefore, Applicants sought to use mammalian display-directed evolution to improve the antigenic profile, thermal stability and expression level of the BG505 SOSIP trimer and germline-targeting trimers.

Applicants' trimer improvement effort focused on two types of libraries: (i) whole gene saturation mutagenesis libraries and (ii) a combinatorial library sampling the one or two most common HIV residues at Env positions where BG505 uses rare (frequency <10%) HIV residues (FIG. 7C). The "rare" library, which allowed variation at eleven positions in gp120 and two in gp41, was screened for binding to trimer structure-preferring bnAbs PGT145, PGT151 and PG16 and for lack of binding to non-neutralizing antibodies b6 and 4025. This yielded the Rare3 clone with five mutations in gp120 (T106E, M271I, F288L, T290A, N363Q) and with the expression level improved by a factor of ~2 and the melting temperature ($T_M$) increased by 1.4° C. (FIG. 13). The saturation mutagenesis library was constructed in three segments, two covering gp120 and one for gp41 (FIG. 7C). Next generation sequencing and bioinformatics were employed to analyze the results of the first two sorts (Jardine et al., 2016a), while Sanger sequencing was used to identify enriched clones that survived four or five sorts. Enriched mutations from both sequencing methods were combined and tested in soluble trimers and were also assembled into combinatorial libraries and re-screened using the same antibodies as before. The gp41 library produced MD2, with an L568D point mutation that increased expression levels by a factor of ~4, and MD33, with four additional mutations (F519S, A561P, V570H, R585H) that increased the $T_M$ by 4° C. and improved expression by a factor of ~7 relative to BG505 SOSIP (FIG. 13). The gp120 library produced MD16, with three mutations (F223W, R304V, A319Y) and reduced binding to V3 non-neutralizing antibodies (FIG. 12). Finally, mutations from Rare3, MD16 and MD33 were combined to produce MD39 with 11 mutations (F223W and T290A did not improve the biophysical properties of the trimer and were excluded; data not shown). Compared to BG505 SOSIP.D664, the MD39 yield improved by a factor of ~7, $T_M$ increased by ° C., and antigenic profile improved by reduced V3 Ab reactivity and similar bnAb binding except for slightly reduced affinities for V2 apex bnAbs (FIGS. 7A, 7B and 13)

Combining the MD39 mutations with germline-targeting mutations produced germline-targeting trimers with improved properties. MD39-10MUT had 6-fold improved yield and 6° C. higher $T_M$ compared to 10MUT (FIGS. 7A and 13). Applicants' most advanced germline-targeting trimer, MD39-11MUT$_B$, the only trimer with detectable affinity for five of six PGT121-germline reverted variants tested (FIG. 7B), had excellent yield, thermal stability and antigenic profile (FIG. 7A, B). Directed evolution therefore produced native-like trimers with improved potential functionality via both stabilization and germline-targeting mutations.

Structural Analysis.

To ascertain whether stabilized, PGT121-germline-targeting trimers maintain native-like structure, Applicants conducted crystallography and electron microscopy (EM) studies. Negative stain EM two-dimensional classification revealed that all four trimers tested (MD39, 10MUT, MD39-10MUT, and MD39-11MUT$_B$) were characterized by a high fraction (≥95%) of native-like structural features and were similar in appearance to BG505 SOSIP. The MD39 mutations improved the structural uniformity of the 10MUT trimer, as the amount of flexible, native open conformations dropped from 35% to 5% between 10MUT and MD39-10MUT (see methods for description of 2D classification system). Applicants' best germline-targeting trimer, MD39-11MUT$_B$, exhibited 100% native closed conformations and was indistinguishable from BG505 SOSIP by EM. For higher resolution analysis, Applicants solved a 4.5 Å resolution crystal structure of MD39-10MUT$_A$, a variant of MD39-10MUT with one mutation added and another removed (Supplemental Methods), complexed with 35022 and PGT124 (Garces et al., 2014; Sok et al., 2013). While this resolution precluded analyses of side-chain conformations, and the interface between trimer and PGT124 could not be analyzed due to missing V1 loop density, the structure accurately determined the backbone positions for most (1659 of 1692) residues of gp140. Superposition of the gp140 backbones in this structure and in the 3.0 Å structure of BG505 SOSIP N137A complexed with 3H109L and 35022 (PDBid: 5CEZ) or the 3.1 Å structure of BG505 SOSIP bound to PGT122 and 35022 (PDBid: 4TVP) gives backbone rmsd values of 0.7 and 1.1 A, respectively. Applicants conclude that MD39-10MUT$_A$, with 20 mutations relative to BG505 SOSIP T332N, retains an overall native-like conformation.

Sequential Boosting Strategies.

Figures 8A, 8B, 8C:
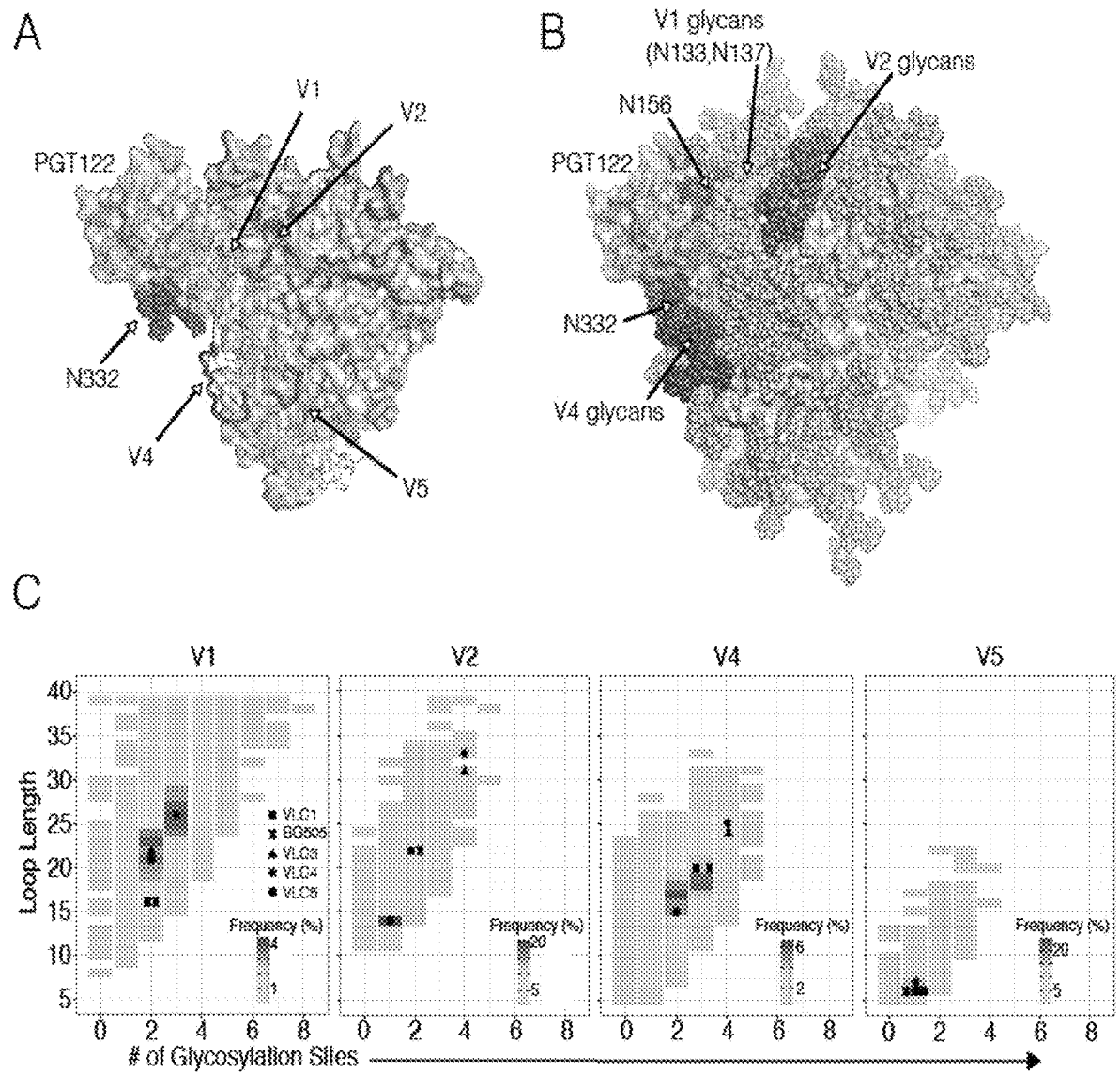
Figures 8D, 8E, 8F:
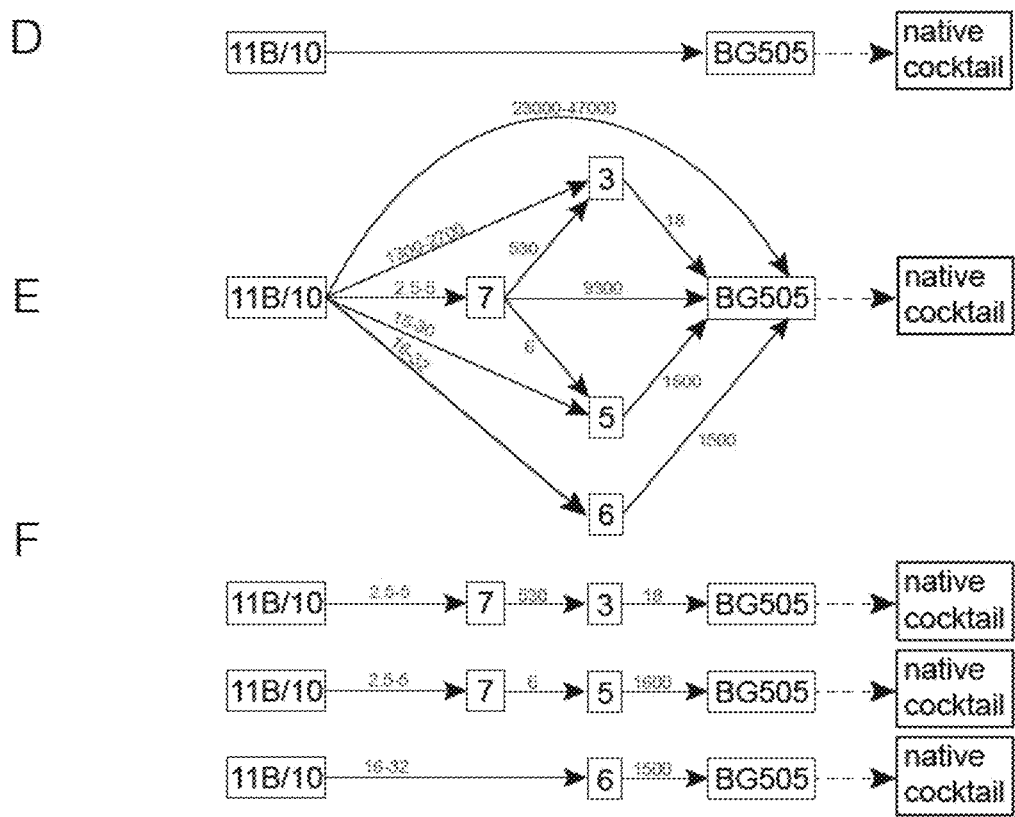

As noted above, induction of bnAbs following a germline-targeting prime is expected to require sequential boosting with epitope variants to mature the response. With PGT121-class germline-targeting candidates (10MUT and 11MUT$_B$) in hand, Applicants developed boosting strategies aiming to select PGT121-like mutations and induce bnAbs. Applicants hypothesized that any sequential immunization strategy starting with a germline-targeting trimer should end with a native-like trimer, such as BG505 MD39 SOSIP, so as to select mutations productive for high-affinity interaction with the native trimer on the virus. However, in order for PGT121-class antibodies to engage their epitope including the N137 glycan on the V1 loop, such antibodies must accommodate V1 loops diverse not only in sequence but also in length and number of glycosylation sites (FIG. 8A-C), implying that boosting with a single native-like trimer bearing a single V1 loop may not be sufficient. Indeed, boosting only with a BG505 native-like trimer would present a V1 loop that is significantly shorter than most (FIG. 8B). Furthermore, modeling of variable loops and glycan conformations (not shown) suggested that diversity in the V2 and V4 loops might potentially impact the PGT121 epitope by altering conformational sampling of the V1 loop or N332 glycan, respectively (FIGS. 8A-C), and immunodominant responses involving V2 or V4 could potentially sterically interfere with PGT121-class boosting. Based on these considerations, Applicants hypothesized that a cocktail of native-like trimers displaying diverse variants of the V1, V2, and V4 loops, especially variants within "hotspots" of more frequently-occurring combinations of length and number of glycosylation sites (FIG. 8B), might be needed to select PGT121-class mutations favoring neutralization breadth. Applicants therefore designed and produced four native-like trimers based on BG505 MD39 SOSIP containing diverse loops for V1, V2, V4, and V5 (FIGS. 8C, 14A and 14B). These trimers, together with BG505 MD39 SOSIP, form a five-member variable loop cocktail (VLC) that might broaden PGT121-like responses initiated by a germline-targeting trimer (FIG. 8D).

Applicants then considered the question of what intermediate boosts, if any, might be employed between a germline-targeting prime and a native-like trimer. Applicants' germline-targeting design intermediates become increasingly more native-like in the PGT121 epitope (e.g. 7MUT, 5MUT and 3MUT have six, four and two epitope mutations, respectively), but the 5MUT and 3MUT mutations are mutually exclusive (3MUT lacks two V1 glycans while 5MUT has those glycans but has four other V1 loop mutations) (FIG. 6A). These considerations impose directionality on any boosting scheme (e.g. 7MUT should not be used after 5MUT or 3MUT or WT, and 3MUT should not be used after 5MUT), thus limiting the number of possible schemes (Table 2). Considering only the most efficient directional schemes, those employing boosting pairs that differ by more than one mutation or involve substantial affinity changes (Table 3), Applicants identified a total of seven potential boosting schemes (FIG. 8E).

Applicants sought to rank these schemes to allow prioritization for experimental testing. Applicants reasoned that the least mutated antibody that shows measurable affinity for all of the potential boosting immunogens, GL+9, could serve as a proxy for intermediate PGT121-class antibodies developing after a germline-targeting prime and before a native-like boost. Applicants further reasoned that the affinity drop, the ratio of GL+9 affinities for two immunogens, could be used to estimate the likelihood of successfully boosting memory B cells when the two immunogens are used in sequence (e.g. the GL+9 $K_D$s for 7MUT and 3MUT are 3 nM and 1600 nM respectively, so when immunizing with 7MUT followed by 3MUT, the affinity drop would be 1600/3=530). One expects that a boost immunogen with very different epitope structure from the previous immunogen may result in too large an affinity drop to activate memory B cells generated by the prior immunogen. Applicants estimated the affinity drops for all seven boosting schemes (FIG. 8E), ranked them according to the largest affinity drop in that boosting scheme, and listed the three most likely to succeed (FIG. 8F).

In collaborating work, Escolano and colleagues (Escolano et al., 2016) evaluated boosting schemes following the 10MUT trimer prime in PGT121 germline ($GL_{CDR3-rev4}$) knock-in mice and PGT121 mature-heavy-chain/germline-light-chain knock-in mice. Relying on the directionality of the boosting immunogens developed here, Escolano et al. used serum ELISA against boost candidates after each immunization to select the most native-like directional boost for which at least weak serum reactivity could be detected; that process resulted in the testing of the second scheme in FIG. 8F and the finding that this scheme induces PGT121-like bnAbs with substantial breadth and potency. While the first scheme in 12F remains to be tested, the data in Escolano et al. support the validity of the logic underlying these boosting schemes.

Applicants note that the affinity drop analysis also provides clues on how to improve boosting schemes: to minimize the probability of a boost failure at a high affinity drop, one could redesign immunogens to equalize the affinity drops in any given scheme. Thus the germline-targeting design process is capable of defining potential boost immunogens and directional boosting schemes, and it can guide prioritization and improvement of such schemes.

Germline-targeting vaccine design offers the potential to initiate the induction of specific classes of protective antibodies against HIV or other pathogens that have eluded vaccine development. Many protective bnAbs against HIV are directed toward glycan-dependent epitopes on the trimeric glycoprotein spike (Burton and Hangartner, 2016). Therefore, methods are needed to develop trimer immunogens for germline targeting and boosting of glycan-dependent bnAbs. Trimer immunogens should be stabilized, to maximize the probability of retaining native-like conformational epitopes in vivo and to minimize the probability of eliciting non-neutralizing Abs that could potentially detract from priming or boosting the targeted bnAb responses.

Here, Applicants (1) developed a mammalian cell surface display directed evolution method for optimization of multimeric antigens bearing human glycans; (2) engineered stabilized HIV Env trimers with affinity for both germline and mature PGT121-class glycan-dependent bnAbs; (3) showed by crystallography and electron microscopy that these trimers maintain native-like conformations; (4) demonstrated that germline-targeting trimers multimerized on liposomes potently activate PGT121 germline and mature B cells ex vivo; and (5) showed that soluble germline-targeting trimers can prime PGT121-class responses in vivo, in a PGT121 inferred-germline knock-in mouse. Applicants' data indicate that $11MUT_B$ trimers and trimer-liposomes are promising candidates for priming PGT121-class glycan-dependent bnAb responses in immune systems with diverse antibody repertoires, although the frequency of PGT121-class precursors in humans and the germline-targeting affinities/avidities necessary to prime those precursors remain to be determined.

This work may provide a more general template for HIV bnAb germline-targeting compared to previous work on germline-targeting for VRCO1-class bnAbs directed to the CD4-binding site. VRCO1-class bnAbs generally do not depend on glycans for their activity, evidenced by the fact that elimination of glycans surrounding the VRCO1 epitope generally increases neutralization potency (Jardine et al., 2016b); this has led to removal of all epitope-proximal glycans from germline-targeting candidates (Jardine et al., 2013; 2015; 2016a; McGuire et al., 2013; 2014; 2016). However, the activity of many HIV bnAbs requires engagement of one or more glycans within their epitope, and germline-targeting primes should probably retain such key glycans, as was the case here with the N332 glycan. Furthermore, owing to the relative inaccessibility of the VRCO1 epitope on native-like trimers, efforts to design VRCO1-class germline-targeting primes have converged on strategies to increase epitope exposure by presentation on minimal domains rather than on trimers (Jardine et al., 2013; 2015; 2016a; McGuire et al., 2013; 2014; 2016), although boosting with native-like trimers is anticipated to be required to mature the response (Jardine et al., 2016b). In contrast, many proteo-glycan epitopes are well exposed on native-like trimers, and some are formed only on intact trimers, making native-like trimers like those designed here the preferred platform for germline-targeting. Indeed, multiple different bnAbs could potentially be primed with a single trimer harboring multiple germline-targeting epitopes.

As germline-targeting vaccine design requires developing not only the vaccine prime but also boost immunogens to mature the response in order to elicit bnAbs, Applicants developed both a stabilized native-like trimer (MD39) and a cocktail of native-like trimers (VLC cocktail) that could be employed as boosts to refine and expand the breadth of responses initiated by a germline-targeting prime. However, considering that memory B cells induced by the germline-targeting prime may not be sufficiently mutated to be boosted by a native-like trimer, intermediate boosts may be needed to mature the response prior to native-like boosts. In the process of developing PGT121-class germline-targeting immunogens, Applicants created design intermediates with increasing levels of epitope modification between wild-type and germline-targeting trimers. These molecules are candidate boost immunogens that if used in sequence offer directional and gradual epitope changes to guide maturation of the B cell response. Seven potential sequential immunization schemes were proposed, and Applicants' analysis of affinity drops provided a ranking of those schemes. In a related paper (Escolano et al., 2016), a subset of these prime-boosting schemes were evaluated in PGT121 germline knock-in mice and PGT121 mature-heavy-chain/germline-light-chain knock-in mice, and one such scheme was found to be effective for inducing bnAbs in both mouse models, supporting the germline-targeting vaccine design process described here and encouraging its expanded use and further improvement.

While here Applicants have described strategies for designing trimer immunogens with changes in the structure of an epitope in order to prime and mature an epitope-specific response, ultimate success of these strategies may also require modification of antigenic surfaces outside the epitope of interest, to minimize boosting of off-target responses that might hinder or interfere with the desired epitope-specific response.

The approaches employed here could be adapted for immunogen design to other bnAb targets on HIV and other pathogens. The "bootstrapping" strategy of using partially mutated antibodies (such as GL+3 and GL+9) as initial selection agents and then using antibodies closer to germline in successive iterations, could be useful for design of germline-targeting and boosting immunogens for other bnAbs, such as HIV V2 Apex glycan-dependent bnAbs (Andrabi et al., 2015; Gorman et al., 2016) or influenza virus hemagglutinin stem-directed bnAbs. Applicants' mammalian display methods allowing directed evolution on native-like trimers should be useful in those endeavors and could also be used to stabilize monomeric or multimeric glycoprotein immunogens for diverse viral vaccines.

In summary, Applicants have developed stabilized native-like trimer immunogens for germline-targeting and boosting of glycan-dependent PGT121-class bnAb responses against HIV. The immunogens and boosting schemes Applicants created are candidates for human vaccine testing and further optimization, while the methods developed here are applicable to immunogen design for other epitopes and pathogens and thus are of relevance for future vaccine design.

DNA Gene Synthesis and Protein Production.

Genes were synthesized by GenScript. Gp120s, gp140s, Fabs and IgGs were expressed in 293 cells and purified as described below.

Library Assembly.

The BG505 SOSIP whole gene saturation mutagenesis and "rare amino acid" libraries were synthesized by Integrated DNA Technologies and GenScript, respectively. Libraries for germline targeting were created by error prone PCR (gene morph II Agilent), site directed mutagenesis (QuikChange Agilent) or 2-step assembly PCR of degenerate primers using the Q5 High-Fidelity DNA Polymerase (New England Biolabs) and cloned into a modified version of the gateway cloning entry vector pENTR/D-TOPO (Ota et al., 2012) using the circularpolymeraseextension cloning (CPEC) method (Quan and Tian, 2014) or Gibson Assembly (New England Biolabs) according to manufacturer's instructions. All libraries were then transferred to the lentiviral vector pLenti CMVTRE3G puro Dest (Ota et al., 2012) using the LR Clonase II enzyme mix (Thermo Scientific).

Lentivirus Production and Stable Cell Generation.

293T cells cultured in Advanced DMEM (Gibco) supplemented with 5% FCS, GlutaMAX (Gibco), 2-mercaptoethanol (Gibco) and Antibiotic-Antimycotic (Gibco) were co-transfected with 10.8 µg pLenti CMVTRE3G puro Dest gene library, 7.0 µg psPAX2 and 3.8 µg pMD2. G as described (Salmon and Trono, 2007). 293T cells stably expressing rtTA3G from the pLenti CMV rtTA3G Blast vector (Ota et al., 2012) were transduced at low moi (<0.1) in a T75 or T225 flask in the presence of 10 µg/mL blasticidin and after 24 h transferred to medium supplemented with 2 µg/mL puromycin.

Cell Surface Expression and FACS.

293T cells containing the stable library were induced with doxycycline (1 µg/mL) and harvested the next day in FACS buffer (HBSS, 1 mM EDTA, 0.5% BSA). Cells containing BG505-SOSIP libraries were transfected with furin 24 h prior to induction. Cells were stained with IgGs or Fabs for ~30 min, washed with FACS buffer, and then stained with fluorescein isothiocyanate (FITC)-labeled α-cMyc (Immunology Consultants Laboratory). IgGs were labeled with phycoerythrin (PE)-conjugated α-human IgG (Sigma), Fabs containing HA epitope tags (PGT145, PGT151, and PG16) were labeled with α-HA-PE (Miltenyi Biotec) and Fabs containing V5 epitope tags (B6 and 4025) were labeled with α-V5-FITC (GeneTex). Cells were sorted on a BD Influx (BD Biosciences) FACS sorter. Approximately $2 \times 10^5$ double positive cells were collected and expanded for ~one week in the presence of puromycin and blasticidin before the next round of enrichment. Once the desired population had been obtained, chromosomal DNA was extracted from the cell culture using the GenElute Mammalian Genomic DNA Miniprep Kit (Sigma). The gp120 or gp140 gene was PCR amplified from the genomic DNA and inserted back into the pENTR vector using CPEC cloning or Gibson assembly, transformed into top10 competent cells (Invitrogen) and colonies were sequenced at Genewiz.

Next Generation Sequencing (NGS).

Sequencing and bioinformatic analysis of the BG505-SOSIP whole gene saturation mutagenesis libraries were done essentially as described previously (Jardine et al., 2016a).

Trimer-conjugated liposome synthesis and characterization. Unilamellar liposomes comprised of DSPC:cholesterol:DGS-NTA(Ni) lipids in a 66.5:28.5:5 mole ratio were synthesized by lipid film rehydration and membrane extrusion, followed by post-synthesis binding of 6×His-tagged trimer ("6×His" disclosed as SEQ ID NO: 114) for 2 hrs at 4° C. Unconjugated trimer was removed by size exclusion chromatography. Total conjugated trimer was quantified by ELISA in the presence of 1% triton-X and 100 mM imidazole to fully disrupt liposomes and Ni-6×His interactions ("6×His" disclosed as SEQ ID NO: 114), respectively, for uninhibited detection via an α-6×His antibody ("6×His" disclosed as SEQ ID NO: 114). Antigenic profiles were determined by ELISA on intact liposomes.

$Ca^{2+}$-Flux Measurements and Immunizations.

Details about $Ca^{2+}$-flux assays and mouse immunizations can be found in Extended experimental procedures and in (Escolano et al., 2016).

Negative-Stain Electron Microscopy.

Purified SOSIP trimers were analyzed by negative stain EM using a protocol adapted from (de Taeye et al., 2016).

Differential scanning calorimetry (DSC) and Surface plasmon resonance (SPR) methods are described in the Extended experimental procedures.

TABLE 1

The binding affinities of germline targeting gp120s, related to FIG. 6.

| BG505-gp120 | PGT121 | 3H3L | GL + 9 | GL + 3 | $GL_{CDR3\text{-}mat}$ | $GL_{CDR3\text{-}rev5}$ | $GL_{CDR3\text{-}rev4}$ |
|---|---|---|---|---|---|---|---|
| WT (T332N) | 7.5 | 250 | 28000 | >128000 | >128000 | >8000 | >84000 |
| 2MUT | 2.7 | — | 4900 | >40000 | — | — | >40000 |
| 3MUT | 4.6 | 19 | 1600 | >28000 | >21000 | — | >28000 |
| 5MUT | 5.7 | 2.5 | 18 | WB | WB | — | >34000 |
| 6MUT | 1.4 | — | 19 | >24000 | — | — | >24000 |
| 7MUT | 1.2 | 0.25 | 3 | 12200 | 44000 | — | >36000 |
| $9MUT_A$ | 0.57 | — | — | 2700 | 2900 | — | >70000 |
| $9MUT_B$ | 1.5 | 28 | — | 29000 | WB | — | >107000 |
| 10MUT | 0.59 | 0.04 | 1.2 | 1200 | 790 | WB | >150000 |
| 10MUT-KO | 435 | — | — | — | >21000 | — | >21000 |
| $11MUT_A$ | — | — | — | — | 1200 | — | WB |
| $11MUT_B$ | 0.15 | 0.075 | 0.6 | 600 | 840 | 7700 | WB |

| BG505-gp120 | $GL_{CDR3\text{-}rev3}$ | $GL_{CDR3\text{-}rev2}$ | $GL_{CDR3\text{-}rev1}$ | $GL_{Hrev4}121_L$ | $121_H GL_{L\text{-}rev4}$ |
|---|---|---|---|---|---|
| WT (T332N) | >128000 | — | >8000 | 600 | >38000 |
| 2MUT | — | — | — | 63 | >40000 |
| 3MUT | >11000 | — | — | 22 | >28000 |
| 5MUT | — | — | — | 6 | 13000 |
| 6MUT | — | — | — | 5 | >24000 |
| 7MUT | — | — | — | 1.3 | >36000 |
| $9MUT_A$ | — | — | — | — | 57000 |
| $9MUT_B$ | — | — | — | 220 | 39000 |
| 10MUT | WB | >150000 | WB | — | 47000 |
| 10MUT-KO | — | — | — | 20000 | >21000 |
| $11MUT_A$ | — | — | — | — | 51000 |
| $11MUT_B$ | 3000 | — | 5200 | — | — |

Values are $K_D$s (nM) measured by SPR.
WB, weak binding, not quantified.
—, not measured.

TABLE 2

Sequential boosting pairs that were eliminated based on violation of directionality, related to FIG. 8.

| Sequential boosting pair | Directionality violation |
|---|---|
| 11B → 10/9A | 11B contains the native residue N137 which is mutated to F in 10/9A |
| 6 → 3 | 6 contains the native glycosylation site at N133 which is mutated in 3 |
| 5 → 3 | 5 contains native glycosylation sites at N133 and N137 and both are mutated in 3 |
| 5 → 2 | 5 contains native glycosylation site at N137 which is mutated in 2 |

Any boosting pair in which the first immunogen contains a native residue that is mutated in the second immunogen is a violation of directionality. The immunogen names have "MUT" removed for simplicity.

TABLE 3

Characteristics of sequential boosting paris that obey directionality, related to FIG. 8.

| Sequential boosting pair | Affinity drop# | # of AA changes | # of AA closer to WT | comment |
|---|---|---|---|---|
| 11B/10 → 7 | Small (5/3) | 6/3 | 4/3 | Shown in FIG. 8. |
| 11B/10 → 6 | Medium (32/16) | 7/4 | 5/4 | Shown in FIG. 8. |
| 11B/10 → 5 | Medium (30/15) | 7/5 | 6/5 | Shown in FIG. 8. |
| 11B/10 → 3 | Large (2700/1300) | 9/7 | 8/7 | Shown in FIG. 8. |
| 11B/10 → WT | Large (47000/23000) | 10/9 | 10/9 | Shown in FIG. 8. |
| 7 → 5 | Small (6) | 2 | 2 | Shown in FIG. 8. |
| 7 → 3 | Medium (530) | 4 | 4 | Shown in FIG. 8. |
| 7 → WT | Large (9300) | 6 | 6 | Shown in FIG. 8. |
| 6 → WT | Large (1500) | 5 | 5 | Shown in FIG. 8. |
| 5 → WT | Large (1600) | 4 | 4 | Shown in FIG. 8. |
| 3 → WT | Medium (18) | 2 | 2 | Shown in FIG. 8. |
| 11B/10 → 2 | Large (8200/4100) | 10/8 | 9/8 | Would be followed by: 2 → WT |
| 10 → 9A | Small (4)* | 1 | 1 | Small affinity drop and only 1 mutation, thus inefficient |

TABLE 3-continued

Characteristics of sequential boosting paris that obey directionality, related to FIG. 8.

| Sequential boosting pair | Affinity drop[#] | # of AA changes | # of AA closer to WT | comment |
|---|---|---|---|---|
| 7 → 6 | Small (6) | 1 | 1 | Small affinity drop and only 1 mutation, thus inefficient |
| 6 → 5 | Small (1) | 1 | 1 | Small affinity drop and only 1 mutation, thus inefficient |
| 6 → 2 | Medium (260) | 4 | 4 | Would be followed by: 2 → WT |
| 3 → 2 | Small (3) | 1 | 1 | Small affinity drop and only 1 mutation, thus inefficient |
| 2 → WT | Small (6) | 1 | 1 | Small affinity drop and only 1 mutation, thus inefficient |

[#]Affinity drops were calculated based on binding to the GL + 9 antibody, as described in the text, except where noted otherwise. Affinity drops were defined as small (<10), medium (10-1000), or large (>1000).
*Affinity drops were calculated based on binding to the $GL_{CDR3\text{-}mat}$ antibody.
The immunogen names have "MUT" removed for simplicity.
WT, BG505-T332N.

REFERENCES

Andrabi, R., Voss, J. E., Liang, C. H., Briney, B., McCoy, L. E., Wu, C. Y., Wong, C. H., Poignard, P., and Burton, D. R. (2015). Identification of Common Features in Prototype Broadly Neutralizing Antibodies to HIV Envelope V2 Apex to Facilitate Vaccine Design. Immunity 43, 959-973.

Barbas, C. F., 3rd, Bjorling, E., Chiodi, F., Dunlop, N., Cababa, D., Jones, T. M., Zebedee, S. L., Persson, M. A., Nara, P. L., Norrby, E., et al. (1992). Recombinant human Fab fragments neutralize human type 1 immunodeficiency virus in vitro. Proceedings of the National Academy of Sciences of the United States of America 89, 9339-9343.

Barouch, D. H., Whitney, J. B., Moldt, B., Klein, F., Oliveira, T. Y., Liu, J., Stephenson, K. E., Chang, H. W., Shekhar, K., Gupta, S., et al. (2013). Therapeutic efficacy of potent neutralizing HIV-1-specific monoclonal antibodies in SHIV-infected rhesus monkeys. Nature 503, 224-228.

Burton, D. R., and Hangartner, L. (2016). Broadly Neutralizing Antibodies to HIV and Their Role in Vaccine Design. Annu Rev Immunol 34, 635-659.

Chen, K. C., Wu, C. H., Chang, C. Y., Lu, W. C., Tseng, Q., Prijovich, Z. M., Schechinger, W., Liaw, Y. C., Leu, Y. L., and Roffler, S. R. (2008). Directed evolution of a lysosomal enzyme with enhanced activity at neutral pH by mammalian cell-surface display. Chem Biol 15, 1277-1286.

de Taeye, S. W., Moore, J. P., and Sanders, R. W. (2016). HIV-1 Envelope Trimer Design and Immunization Strategies To Induce Broadly Neutralizing Antibodies. Trends Immunol 37, 221-232.

Dimitrov, D. S. (2010). Therapeutic antibodies, vaccines and antibodyomes. mAbs 2, 347-356.

Doria-Rose, N. A., Schramm, C. A., Gorman, J., Moore, P. L., Bhiman, J. N., DeKosky, B. J., Ernandes, M. J., Georgiev, I. S., Kim, H. J., Pancera, M., et al. (2014). Developmental pathway for potent V1V2-directed HIV-neutralizing antibodies. Nature 509, 55-62.

Dosenovic, P., von Boehmer, L., Escolano, A., Jardine, J., Freund, N. T., Gitlin, A. D., McGuire, A. T., Kulp, D. W., Oliveira, T., Scharf, L., et al. (2015). Immunization for HIV-1 Broadly Neutralizing Antibodies in Human Ig Knockin Mice. Cell 161, 1505-1515.

Escolano, A., Steichen, J., Dosenovic, P., Kulp, D. W., Golijanin, J., Sok, D., Freund, N. T., Gitlin, A. D., Oliveira, T., Araki, T., et al. (in-press). Sequential Immunization Elicits Broadly Neutralizing anti-HIV-1 Antibodies in Ig Knock-in Mice. Cell.

Falkowska, E., Le, K. M., Ramos, A., Doores, K. J., Lee, J. H., Blattner, C., Ramirez, A., Derking, R., van Gils, M. J., Liang, C. H., et al. (2014). Broadly neutralizing HIV antibodies define a glycan-dependent epitope on the prefusion conformation of gp41 on cleaved envelope trimers. Immunity 40, 657-668.

Garces, F., Lee, J. H., de Val, N., de la Pena, A. T., Kong, L., Puchades, C., Hua, Y., Stanfield, R. L., Burton, D. R., Moore, J. P., et al. (2015). Affinity Maturation of a Potent Family of HIV Antibodies Is Primarily Focused on Accommodating or Avoiding Glycans. Immunity 43, 1053-1063.

Garces, F., Sok, D., Kong, L., McBride, R., Kim, H. J., Saye-Francisco, K. F., Julien, J. P., Hua, Y., Cupo, A., Moore, J. P., et al. (2014). Structural evolution of glycan recognition by a family of potent HIV antibodies. Cell 159, 69-79.

Georgiev, I. S., Rudicell, R. S., Saunders, K. O., Shi, W., Kirys, T., McKee, K., O'Dell, S., Chuang, G. Y., Yang, Z. Y., Ofek, G., et al. (2014). Antibodies VRC01 and 10E8 neutralize HIV-1 with high breadth and potency even with Ig-framework regions substantially reverted to germline. Journal of immunology 192, 1100-1106.

Gorman, J., Soto, C., Yang, M. M., Davenport, T. M., Guttman, M., Bailer, R. T., Chambers, M., Chuang, G. Y., DeKosky, B. J., Doria-Rose, N. A., et al. (2016). Structures of HIV-1 Env V1V2 with broadly neutralizing antibodies reveal commonalities that enable vaccine design. Nat Struct Mol Biol 23, 81-90.

Gorny, M. K., Sampson, J., Li, H., Jiang, X., Totrov, M., Wang, X. H., Williams, C., O'Neal, T., Volsky, B., Li, L., et al. (2011). Human anti-V3 HIV-1 monoclonal antibodies encoded by the VH5-51/VL lambda genes define a conserved antigenic structure. PLoS One 6, e27780.

Haynes, B. F., Fleming, J., St Clair, E. W., Katinger, H., Stiegler, G., Kunert, R., Robinson, J., Scearce, R. M., Plonk, K., Staats, H. F., et al. (2005). Cardiolipin poly-specific autoreactivity in two broadly neutralizing HIV-1 antibodies. Science 308, 1906-1908.

Haynes, B. F., Kelsoe, G., Harrison, S. C., and Kepler, T. B. (2012). B-cell-lineage immunogen design in vaccine development with HIV-1 as a case study. Nature biotechnology 30, 423-433.

Hoot, S., McGuire, A. T., Cohen, K. W., Strong, R. K., Hangartner, L., Klein, F., Diskin, R., Scheid, J. F., Sather, D. N., Burton, D. R., et al. (2013). Recombinant HIV envelope proteins fail to engage germline versions of anti-CD4bs bNAbs. PLoS pathogens 9, e1003106.

Hu, J. K., Crampton, J. C., Cupo, A., Ketas, T., van Gils, M. J., Sliepen, K., de Taeye, S. W., Sok, D., Ozorowski, G., Deresa, I., et al. (2015). Murine Antibody Responses to Cleaved Soluble HIV-1 Envelope Trimers Are Highly Restricted in Specificity. J Virol 89, 10383-10398.

Jardine, J., Julien, J. P., Menis, S., Ota, T., Kalyuzhniy, O., McGuire, A., Sok, D., Huang, P. S., MacPherson, S., Jones, M., et al. (2013). Rational HIV immunogen design to target specific germline B cell receptors. Science 340, 711-716.

Jardine, J., Sok, D., Julien, J. P., Briney, B., Sarkar, A., Adachi, Y., Dewanji, D., Hsueh, J., Jones, M., Kalyuzhniy, I., et al (2016b). Minimally Mutated HIV-1 Broadly Neutralizing Antibodies to Guide Reductionish Vaccine Design. PLoS Pathogens.

Jardine, J. G., Kulp, D. W., Havenar-Daughton, C., Sarkar, A., Briney, B., Sok, D., Sesterhenn, F., Ereno-Orbea, J., Kalyuzhniy, O., Deresa, I., et al. (2016a). HIV-1 broadly neutralizing antibody precursor B cells revealed by germline-targeting immunogen. Science 351, 1458-1463.

Jardine, J. G., Ota, T., Sok, D., Pauthner, M., Kulp, D. W., Kalyuzhniy, O., Skog, P. D., Thinnes, T. C., Bhullar, D., Briney, B., et al. (2015). Priming a broadly neutralizing antibody response to HIV-1 using a germline-targeting immunogen. Science 349, 156-161.

Julien, J. P., Cupo, A., Sok, D., Stanfield, R. L., Lyumkis, D., Deller, M. C., Klasse, P. J., Burton, D. R., Sanders, R. W., Moore, J. P., et al. (2013). Crystal structure of a soluble cleaved HIV-1 envelope trimer. Science 342, 1477-1483.

Kepler, T. B., Liao, H. X., Alam, S. M., Bhaskarabhatla, R., Zhang, R., Yandava, C., Stewart, S., Anasti, K., Kelsoe, G., Parks, R., et al. (2014). Immunoglobulin gene insertions and deletions in the affinity maturation of HIV-1 broadly reactive neutralizing antibodies. Cell Host Microbe 16, 304-313.

Klein, F., Diskin, R., Scheid, J. F., Gaebler, C., Mouquet, H., Georgiev, I. S., Pancera, M., Zhou, T., Incesu, R. B., Fu, B. Z., et al. (2013a). Somatic mutations of the immunoglobulin framework are generally required for broad and potent HIV-1 neutralization. Cell 153, 126-138.

Klein, F., Diskin, R., Scheid, J. F., Gaebler, C., Mouquet, H., Georgiev, I. S., Pancera, M., Zhou, T., Incesu, R. B., Fu, B. Z., et al. (2013a). Somatic mutations of the immunoglobulin framework are generally required for broad and potent HIV-1 neutralization. Cell 153, 126-138.

Klein, F., Mouquet, H., Dosenovic, P., Scheid, J. F., Scharf, L., and Nussenzweig, M. C. (2013b). Antibodies in HIV-1 vaccine development and therapy. Science 341, 1199-1204.

Kong, R., Xu, K., Zhou, T., Acharya, P., Lemmin, T., Liu, K., Ozorowski, G., Soto, C., Taft, J. D., Bailer, R. T., et al. (2016). Fusion peptide of HIV-1 as a site of vulnerability to neutralizing antibody. Science 352, 828-833.

Kwon, Y. D., Pancera, M., Acharya, P., Georgiev, I. S., Crooks, E. T., Gorman, J., Joyce, M. G., Guttman, M., Ma, X., Narpala, S., et al. (2015). Crystal structure, conformational fixation and entry-related interactions of mature ligand-free HIV-1 Env. Nat Struct Mol Biol 22, 522-531.

Landais, E., Huang, X., Havenar-Daughton, C., Murrell, B., Price, M. A., Wickramasinghe, L., Ramos, A., Bian, C. B., Simek, M., Allen, S., et al. (2016). Broadly Neutralizing Antibody Responses in a Large Longitudinal Sub-Saharan HIV Primary Infection Cohort. PLoS pathogens 12, e1005369.

Liao, H. X., Lynch, R., Zhou, T., Gao, F., Alam, S. M., Boyd, S. D., Fire, A. Z., Roskin, K. M., Schramm, C. A., Zhang, Z., et al. (2013). Co-evolution of a broadly neutralizing HIV-1 antibody and founder virus. Nature 496, 469-476.

Lyumkis, D., Julien, J. P., de Val, N., Cupo, A., Potter, C. S., Klasse, P. J., Burton, D. R., Sanders, R. W., Moore, J. P., Carragher, B., et al. (2013). Cryo-EM structure of a fully glycosylated soluble cleaved HIV-1 envelope trimer. Science 342, 1484-1490.

Mascola, J. R., and Haynes, B. F. (2013). HIV-1 neutralizing antibodies: understanding nature's pathways. Immunological reviews 254, 225-244.

McGuire, A. T., Hoot, S., Dreyer, A. M., Lippy, A., Stuart, A., Cohen, K. W., Jardine, J., Menis, S., Scheid, J. F., West, A. P., et al. (2013). Engineering HIV envelope protein to activate germline B cell receptors of broadly neutralizing anti-CD4 binding site antibodies. The Journal of experimental medicine 210, 655-663.

McGuire, A. T., Gray, M. D., Dosenovic, P., Gitlin, A. D., Freund, N. T., Petersen, J., Correnti, C., Johnsen, W., Kegel, R., Stuart, A. B., et al. (2016). Specifically modified Env immunogens activate B-cell precursors of broadly neutralizing HIV-1 antibodies in transgenic mice. Nat Commun 7, 10618.

Moldt, B., Rakasz, E. G., Schultz, N., Chan-Hui, P. Y., Swiderek, K., Weisgrau, K. L., Piaskowski, S. M., Bergman, Z., Watkins, D. I., Poignard, P., et al. (2012). Highly potent HIV-specific antibody neutralization in vitro translates into effective protection against mucosal SHIV challenge in vivo. Proceedings of the National Academy of Sciences of the United States of America 109, 18921-18925.

Mouquet, H., Scharf, L., Euler, Z., Liu, Y., Eden, C., Scheid, J. F., Halper-Stromberg, A., Gnanapragasam, P. N., Spencer, D. I., Seaman, M. S., et al. (2012). Complex-type N-glycan recognition by potent broadly neutralizing HIV antibodies. Proceedings of the National Academy of Sciences of the United States of America 109, E3268-3277.

Mouquet, H., Scheid, J. F., Zoller, M. J., Krogsgaard, M., Ott, R. G., Shukair, S., Artyomov, M. N., Pietzsch, J., Connors, M., Pereyra, F., et al. (2010). Polyreactivity increases the apparent affinity of anti-HIV antibodies by heteroligation. Nature 467, 591-595.

Ota, T., Doyle-Cooper, C., Cooper, A. B., Huber, M., Falkowska, E., Doores, K. J., Hangartner, L., Le, K., Sok, D., Jardine, J., et al. (2012). Anti-HIV B Cell lines as candidate vaccine biosensors. Journal of immunology 189, 4816-4824.

Pancera, M., McLellan, J. S., Wu, X., Zhu, J., Changela, A., Schmidt, S. D., Yang, Y., Zhou, T., Phogat, S., Mascola, J. R., et al. (2010). Crystal structure of PG16 and chimeric dissection with somatically related PG9: structure-function analysis of two quaternary-specific antibodies that effectively neutralize HIV-1. J Virol 84, 8098-8110.

Pancera, M., Zhou, T., Druz, A., Georgiev, I. S., Soto, C., Gorman, J., Huang, J., Acharya, P., Chuang, G. Y., Ofek, G., et al. (2014). Structure and immune recognition of trimeric pre-fusion HIV-1 Env. Nature 514, 455-461.

Pugach, P., Ozorowski, G., Cupo, A., Ringe, R., Yasmeen, A., de Val, N., Derking, R., Kim, H. J., Korzun, J., Golabek, M., et al. (2015). A native-like SOSIP.664 trimer based on an HIV-1 subtype B env gene. J Virol 89, 3380-3395.

Quan, J., and Tian, J. (2014). Circular polymerase extension cloning. Methods in molecular biology 1116, 103-117.

Salmon, P., and Trono, D. (2007). Production and titration of lentiviral vectors. Current protocols in human genetics/editorial board, Jonathan L Haines [et al] Chapter 12, Unit 12 10.

Sanders, R. W., Derking, R., Cupo, A., Julien, J. P., Yasmeen, A., de Val, N., Kim, H. J., Blattner, C., de la Pena, A. T., Korzun, J., et al. (2013). A next-generation cleaved, soluble HIV-1 Env trimer, BG505 SOSIP.664 gp140, expresses multiple epitopes for broadly neutralizing but not non-neutralizing antibodies. PLoS pathogens 9, e1003618.

Sanders, R. W., van Gils, M. J., Derking, R., Sok, D., Ketas, T. J., Burger, J. A., Ozorowski, G., Cupo, A., Simonich, C., Goo, L., et al. (2015). HIV-1 neutralizing antibodies induced by native-like envelope trimers. Science 349, aac4223.

Scharf, L., Wang, H., Gao, H., Chen, S., McDowall, A. W., and Bjorkman, P. J. (2015). Broadly Neutralizing Antibody 8ANC195 Recognizes Closed and Open States of HIV-1 Env. Cell 162, 1379-1390.

Scheid, J. F., Mouquet, H., Feldhahn, N., Seaman, M. S., Velinzon, K., Pietzsch, J., Ott, R. G., Anthony, R. M., Zebroski, H., Hurley, A., et al. (2009). Broad diversity of neutralizing antibodies isolated from memory B cells in HIV-infected individuals. Nature 458, 636-640.

Scheid, J. F., Mouquet, H., Ueberheide, B., Diskin, R., Klein, F., Oliveira, T. Y., Pietzsch, J., Fenyo, D., Abadir, A., Velinzon, K., et al. (2011). Sequence and structural convergence of broad and potent HIV antibodies that mimic CD4 binding. Science 333, 1633-1637.

Shingai, M., Donau, O. K., Plishka, R. J., Buckler-White, A., Mascola, J. R., Nabel, G. J., Nason, M. C., Montefiori, D., Moldt, B., Poignard, P., et al. (2014). Passive transfer of modest titers of potent and broadly neutralizing anti-HIV monoclonal antibodies block SHIV infection in macaques. The Journal of experimental medicine 211, 2061-2074.

Shingai, M., Nishimura, Y., Klein, F., Mouquet, H., Donau, O. K., Plishka, R., Buckler-White, A., Seaman, M., Piatak, M., Jr., Lifson, J. D., et al. (2013). Antibody-mediated immunotherapy of macaques chronically infected with SHIV suppresses viraemia. Nature 503, 277-280.

Sok, D., Laserson, U., Laserson, J., Liu, Y., Vigneault, F., Julien, J. P., Briney, B., Ramos, A., Saye, K. F., Le, K., et al. (2013). The effects of somatic hypermutation on neutralization and binding in the PGT121 family of broadly neutralizing HIV antibodies. PLoS pathogens 9, e1003754.

Walker, L. M., Huber, M., Doores, K. J., Falkowska, E., Pejchal, R., Julien, J. P., Wang, S. K., Ramos, A., Chan-Hui, P. Y., Moyle, M., et al. (2011). Broad neutralization coverage of HIV by multiple highly potent antibodies. Nature 477, 466-470.

Walker, L. M., Phogat, S. K., Chan-Hui, P. Y., Wagner, D., Phung, P., Goss, J. L., Wrin, T., Simek, M. D., Fling, S., Mitcham, J. L., et al. (2009). Broad and potent neutralizing antibodies from an African donor reveal a new HIV-1 vaccine target. Science 326, 285-289.

West, A. P., Jr., Scharf, L., Scheid, J. F., Klein, F., Bjorkman, P. J., and Nussenzweig, M. C. (2014). Structural insights on the role of antibodies in HIV-1 vaccine and therapy. Cell 156, 633-648.

Wu, X., Zhou, T., Zhu, J., Zhang, B., Georgiev, I., Wang, C., Chen, X., Longo, N. S., Louder, M., McKee, K., et al. (2011). Focused evolution of HIV-1 neutralizing antibodies revealed by structures and deep sequencing. Science 333, 1593-1602.

Xiao, X., Chen, W., Feng, Y., Zhu, Z., Prabakaran, P., Wang, Y., Zhang, M. Y., Longo, N. S., and Dimitrov, D. S. (2009). Germline-like predecessors of broadly neutralizing antibodies lack measurable binding to HIV-1 envelope glycoproteins: implications for evasion of immune responses and design of vaccine immunogens. Biochemical and biophysical research communications 390, 404-409.

Zhou, T., Georgiev, I., Wu, X., Yang, Z. Y., Dai, K., Finzi, A., Kwon, Y. D., Scheid, J. F., Shi, W., Xu, L., et al. (2010). Structural basis for broad and potent neutralization of HIV-1 by antibody VRC01. Science 329, 811-817.

Example 2: Supplemental Experimental Procedures to Example 1

DNA gene synthesis. Genes were synthesized at Genscript, Inc. Gp120 and gp140 variants in pHLsec contained a C-terminal GTKHHHHHH tag (SEQ ID NO: 115). Genes in pENTR contained a C-terminal cMyc epitope followed by a PDGFR transmembrane domain. IgGs were cloned into pFUSEss and Fabs were in a modified version of pFUSEss (pFABss). DNA was maxi-prepped using a BenchPro 2100.

Protein Production.

BG505-gp120 and variants based on BG505 contained the L111A mutation for more efficient production of monomer compared to other species (Hoffenberg et al., 2013) and the T332N mutation and were expressed in 293F cells grown in 293 Freestyle media (Life Technologies) by transient transfection with 293Fectin (Invitrogen). Protein was harvested from the supernatant 96 h post transfection and purified by nickel affinity chromatography on a HIS-TRAP column (GE) followed by HiLoad 16/600 Superdex 200 size exclusion chromatography (GE Healthcare). Gp140 SOSIPs were expressed in 293F cells grown in 293 Freestyle media by transient transfection with either 293Fectin or PEI. The protein was purified from the supernatant using a HIS-TRAP column, starting with a wash buffer (20 mM Imidazole, 500 mM NaCl, 20 mM Na2HPO4) and mixing with elution buffer (500 mM Imidazole, 500 mM NaCl, 20 mM Na2HPO4) using a linear gradient. The trimer fraction was collected and further purified on an S200 Increase 10-300 column (GE) in HBS (10 mM HEPES, 150 mM NaCl). The oligomeric state of the SOSIP trimers were then confirmed by size exclusion chromatography-multi-angle light scattering (SECMALS) using the DAWN HELEOS II multi-angle light scattering system with Optilab T-rEX refractometer (Wyatt Technology). The trimers were frozen in thin-walled PCR tubes at 1 mg/ml using liquid nitrogen and stored at −80° C. (Jardine et al., 2015). Fabs and mAbs were produced in 293F cells as described previously (Jardine et al., 2013). For crystallography, SOSIP_MD39_10MUTA was expressed in 293S cells.

ELISA Quantification of SOSIP Expression.

BG505 SOSIP variants were expressed using the Freestyle 293F expression system (Thermo Scientific) according to manufacturer's instructions. After 4 days, supernatants were harvested by centrifugation and stored at 4° C. until analysis. Capture ELISAs were performed essentially as described previously (Schiffner et al., 2016). Briefly, ELISA plates were coated overnight with trimer specific PGT145 Fab at 4 µg/mL in PBS at 4° C. followed by blocking with 2% w/v bovine serum albumin (BSA) in washing buffer (PBS+0.05% v/v tween20). SOSIP expression supernatants were diluted 100× in sample buffer (washing buffer+1% w/v BSA) and for each variant, a standard curve with known concentration of matching purified protein was prepared in sample buffer.

Supernatants and standard curves were added to ELISA plates and detected with trimer preferring IgG PGT151 at 10 µg/mL in sample buffer. Samples were labeled with horseradish peroxidase coupled Fcg-specific anti-human IgG (Jackson Immunoresearch), developed and stopped with 1-Step Ultra TMB-ELISA substrate (Thermo Scientific) as per manufacturer's instructions, and optical densities were read at 450 nm and 570 nm. After background subtraction, data were fit to a "one-site specific binding with hill slope" curve in graphpad prism, and supernatant concentrations were extrapolated from standard curves.

Surface Plasmon Resonance (SPR).

Kinetics and affinities of antibody-antigen interactions were measured on a ProteOn XPR36 (Bio-Rad) using GLC Sensor Chip (Bio-Rad) and 1×HBS-EP+pH 7.4 running buffer (20× stock from Teknova, Cat. No H8022) supplemented with BSA at 1 mg/ml. Human Antibody Capture Kit was used according to manufacturer's instructions (Cat. No BR-1008-39 from GE) to immobilize about 6000 RUs of capture mAb onto each flow cell. In a typical experiment, approximately 300-400 RUs of mAbs were captured onto each flow cell and analytes were passed over the flow cell at 50 L/min for 3 min followed by a 5 min dissociation time. Regeneration was accomplished using 3M Magnesium Chloride with 180 seconds contact time and injected four times per cycle. Raw sensograms were analyzed using ProteOn Manager software (Bio-Rad), including interspot and column double referencing, and either Equilibrium fits or Kinetic fits with Langmuir model, or both, were employed when applicable. Analyte concentrations were measured on a NanoDrop 2000c Spectrophotometer using Absorption signal at 280 nm (Jardine et al., 2015). Applicants measured kinetics and affinity of antibody-Fab-fragment antigen interactions on ProteOn XPR36 (Bio-Rad) using HTE Sensor Chip (Bio-Rad) and running buffer with 20 mM Sodium Phosphate Dibasic, pH 7.4, 500 mM Sodium Chloride, 50 mM Imidazole, supplemented with BSA at 1 mg/ml and Tween 20 detergent at 0.05% v/v. Applicants used 0.1 M Nickel sulfate as activation solution. 0.5 M EDTA was Applicants' regeneration solution with 300 seconds contact time and injected two times per cycle (one time each for vertical and horizontal orientation). Raw sensograms were analyzed using ProteOn Manager software (Bio-Rad), interspot and column double referencing, Equilibrium or Kinetic with Langmuir model or both where applicable. Analyte concentrations were measured on NanoDrop 2000c Spectrophotometer using Absorption signal at 280 nm.

Design of PGT121 Germline-Targeting Immunogens.

BG505-gp120 T332N fused to the PDGFR transmembrane domain (TM) was subjected to random mutagenesis using error prone PCR (gene morph II Agilent), and the resulting PCR product was gel purified and ligated into a modified version of the gateway cloning entry vector pENTR/D-TOPO (Ota et al., 2012) using the circular polymerase extension cloning (CPEC) method (Quan and Tian, 2014). The ligated vector containing the error prone library was purified using the PCR purification kit (Qiagen) and concentrated. The concentrated library was then transformed into electroMAX DH5a-E competent cells (Invitrogen) and grown overnight at 37° C. in a 125 mL culture. The plasmid was purified using the BenchPro® 2100 (Invitrogen) and the gp120 insert was transferred to the lentiviral vector pLenti CMVTRE3G puro Dest (Ota et al., 2012) using the LR Clonase II enzyme mix (Invitrogen). The LR clonase reaction was scaled up ~10-fold to increase library size. The LR clonase product was again purified, concentrated and transformed into electroMAX stbl4 competent cells (Invitrogen) and grown overnight at 30° C. in a 125 mL culture. This plasmid DNA was purified and ready for use in transfection. 293T cells cultured in Advanced DMEM (Gibco) supplemented with 5% FCS, GlutaMAX (Gibco), 2-mercaptoethanol (Gibco) and Antibiotic-Antimycotic (Gibco) were co-transfected with the BG505-gp120 error prone PCR library in pLenti CMVTRE3G puro Dest (10.8 µg), psPAX2 (7.0 µg) and pMD2. G (3.8 µg) with fugeneHD in a T75 flask (Salmon and Trono, 2007). The cells were kept at 37° C. for two days and then the media containing the virus was collected and spun down at 500 g for 5 min. 293T cells stably expressing rtTA3G from the pLenti CMV rtTA3G Blast vector (obtained from Dave Nemazee; (Ota et al., 2012)) were transduced at low moi (<0.1) in a T75 or T225 flask in the presence of 10 µg/mL blasticidin. The next day cells were selected with 2 µg/mL puromycin. 293T cells containing the stable library were induced with doxycycline (1 µg/mL) and the following day were harvested in FACS buffer (HBSS, 1 mM EDTA, 0.5% BSA). Cells were stained with either the GL+9 or GL+3 Ab for ~30 min, washed with FACS buffer, and then stained with fluorescein isothiocyanate (FITC)-labeled α-cMyc (Immunology Consultants Laboratory) and phycoerythrin (PE)-conjugated α-human IgG (Sigma). Cells were sorted on a BD Influx (BD Biosciences) FACS sorter. Approximately 2×10 GL+9 positive cells were collected and expanded for ~one week in the presence of puromycin and blasticidin before the next round of enrichment was carried out. There was no enrichment for GL+3 positive cells after several rounds of sorting so only the GL+9 positive cells were sequenced. Once the desired population had been obtained the chromosomal DNA was extracted from the cell culture using the GenElute Mammalian Genomic DNA Miniprep Kit (Sigma). The BG505-gp120 gene was PCR amplified from the genomic DNA and ligated back into the Gateway entry vector using CPEC cloning and transformed into top10 competent cells. Later in the design process Gibson assembly was substituted for CPEC cloning. Colonies were sequenced at Genewiz. The sequences were highly enriched for two clones, one containing the N137 glycan knockout by the mutation T139I and the other containing the N133 glycan knockout by the mutation T135A in addition to the T139I mutation. These constructs were called 2MUT (T332N, T139I) and 3MUT (T332N, T135A, T139I). Measuring the affinities of gp120-2MUT and gp120-3MUT against a panel of partially mutated PGT121 Abs (table S1) indicated that knocking out both glycans gave a larger boost in affinity compared to only the N137 glycan-KO so 3MUT was used for further designs.

In parallel to screening the error prone PCR library, a combinatorial library was created based on the structure of PGT122 in complex with BG505 SOSIP (PDB IDs 4NCO and 3J5M). Because the initial SOSIP structures were low resolution and structures of germline PGT121 showed light chain conformational changes Applicants elected to do a saturation mutagenesis combinatorial library that would roughly cover the length of the V1 loop that could potentially interact with germline PGT121 Abs. The library was generated by PCR amplifying the BG505 SOSIP construct in two partially overlapping fragments. The C-terminal fragment was amplified with a primer containing the degenerate codon NNK at four positions in the V1 loop (V134, N136, I138, and D140) as well as a degenerate base encoding N or D at position 137. The two PCR products were ligated together using a second round of PCR, and this second PCR product was inserted into the pENTR vector as described above. The resulting construct was transferred to the pLenti CMVTRE3G puro Dest vector, and lentivirus was produced. Stable cells were stained with the GL+3 Ab and α-cMyc, and double positive cells were sorted. This resulted in a binding population that was sequenced and found to be a single unique clone containing the mutations V134Y, N136P, I138L, D140N. This clone was called 5MUT (T332N, V134Y, N136P, I138L, D140N). These mutations were combined with the T139I mutation (6MUT) or the T135A/T139I mutations (7MUT).

Next, a saturation mutagenesis scanning library was created on the gp120-7MUT construct using site directed mutagenesis with the QuikChange kit (Agilent Technologies) with a unique NNK/MNN primer pair for each position that was scanned. 11 positions in the V1 loop (T132 to M142) and 10 positions in the V3 loop (T320 to Q328) were scanned and the resulting 21 reactions were pooled, purified, concentrated, and transformed into electroMAX DH5a-E competent cells and transferred to pLenti CMVTRE3G puro Dest as described above. This library was then stained separately with $GL_{CDR3mat}$, $GL_{CDR3rev4}$, or a Chimeric Ab containing the mature PGT121 heavy chain paired with the $GL_{CDR3rev4}$ light chain (121H/GLL-rev4), as well as α-cMyc for expression. Double positive cells were sorted and 3 mutations were enriched in the $GL_{CDR3mat}$ sort (N137F, T320F, Q328M) and two mutations were enriched in the 121H/GLL-rev4 sort (N135R, Q328M) whereas a binding population was not obtained in the $GL_{CDR3rev4}$ sort. Combining these mutations with 7MUT resulted in $9MUT_A$ (7MUT+N137F/Q328M), $9MUT_B$(7MUT+N135R/Q328M), and 10MUT (7MUT+N137F/T320F/Q328M). The $9MUT_B$ protein showed improved binding to 121H/GLL-rev4 but worse binding to all other PGT121-class antibodies tested compared to 7MUT (from which $9MUT_B$ was derived) and so $9MUT_B$ was not selected for further use except as a control for the chimeric antibody (data not shown). Gp120-10MUT showed better binding to $GL_{CDR3mat}$ compared to gp120-$9MUT_A$ and T320F was used in subsequent designs with the exception of Applicants' SOSIP-$10MUT_A$ crystal structure, which lacks the T320F mutation.

Having established ~1 μM binding to the $GL_{CDR3mat}$ Ab with 10MUT Applicants' goal was to improve the immunogen to tolerate more variation within the H-CDR3. For this Applicants created three more V1 loop combinatorial libraries each containing four NNK codons. The three libraries contained NNK codons at positions (A135/P136/F137/L138), (F137/L138/I139/N140), and (I139/N140/D141/M150). Each library was assembled from two partially overlapping ultramers (Integrated DNA Technologies) and ligated into the gp120-10MUT gene using gibson assembly (New England Biolabs). The three libraries were pooled and screened against zup $GL_{CDR3rev2}$ and $GL_{CDR3rev4}$ Abs. Sorting against the $GL_{CDR3rev4}$ Ab resulted in enrichment for the D141N mutation ($11MUT_A$) and sorting against the $GL_{CDR3rev2}$ resulted in enrichment for L139 and S140 with the most frequent clone containing the sequence N137/L138/L139/S140. When these mutations were combined with the D141N mutation as well as a T415V mutation, which Applicants had identified as being beneficial for binding to PGT121 on an engineered outer domain construct (data not shown), it resulted in $11MUT_B$ Development of BG505-SOSIP_MD39.

BG505 SOSIP "Rare Amino Acid" Library.

The BG505 SOSIP "rare amino acid" library was synthesized at GenScript. It was first sorted against PG16 followed by a sort for a high PGT145/B6 binding ratio. The cells were expanded for 1 week and then sorted for either high PGT145/B6 or high PGT151/4025. After six rounds of sorting the library was sequenced (Genewiz). PGT145, PGT151, and PG16 Fabs contained HA epitope tags and were labeled with α-HA-PE (Miltenyi Biotec). B6 and 4025 Fabs contained V5 epitope tags and were labeled with α-V5-FITC (GeneTex).

BG505 SOSIP Whole Gene Saturation Mutagenesis.

The whole gene saturation mutagenesis library was synthesized at Integrated DNA Technologies in four segments that each contained ~150 NNK codons that were cloned into the BG505-SOSIP gene using either CPEC or Gibson assembly which resulted in four libraries. NNK codons were barcoded with a silent mutation on each side. The libraries created from the second and third segments were combined into one. The first, second and third libraries had NNK codons covering residues Y39-N185, N186-R500 and K502-Q658, respectively. The library that covered gp41 (502-658) was sorted for high PGT145/cMyc, high PGT145/B6, and high PGT151/cMyc. The first gp120 library (39-185) was sorted for high PGT145/B6, and high PGT151/4025. The second gp120 library (186-500) was sorted for high PGT145/cMyc, high PGT145/B6, high PGT151/4025, and high PGT151/cMyc. The sorted libraries were sequenced and analyzed essentially as described previously (Jardine et al., 2016). Positions that enriched for the same amino acid against multiple different mAb sorts (E.g. PGT145(+)/B6(−) and PGT151(+)/4025(−)) were favored for testing in follow up combinatorial libraries or directly testing in recombinantly purified protein. Combinatorial libraries based on the next generation sequencing analysis were assembled from overlapping ultramers and sorted against the same antibodies described above.

Differential Scanning Calorimetry (DSC).

DSC experiments were performed on a MicroCal VP-Capillary differential scanning calorimeter (Malvern Instruments). The HEPES buffered saline (HBS) buffer was used for baseline scans and the protein samples were diluted into HBS buffer to adjust to 0.25 mg/ml. The system was allowed to equilibrate at 20° C. for 15 min and then heat up till 90° C. at a scan rate of 90° C./h. Buffer correction, normalization, and baseline subtraction were applied during data analysis using Origin 7.0 software. The non-two-state model was used for data fitting.

ELISA to Characterize Antigenic Profile of Native-Like Trimers.

96-well plates were coated overnight at 4° C. with 6×-His Epitope Tag Antibody ("6×His" disclosed as SEQ ID NO: 114) (Thermofisher) at 2 mg/ml in PBS. Plates were washed 3 times with PBS, 0.05% Tween (PBS-T), and blocked with 10% milk PBS for 1 h. Subsequently, 2 mg/ml of the purified His-tagged SOSIP protein was added for 2 h in 1% milk PBS-T, after which the plates were washed three times with PBS-T. Serial dilutions of mAbs in 1% milk PBS-T were added to the plates for 1 h, after which the plates were washed again three times with PBS-T before the addition of anti-human Fc region-conjugated alkaline phosphatase (Jackson Immunoresearch) at 1:1000 for 1 h. After four final washes, binding was detected by the addition of alkaline phosphatase substrate and measured by absorbance at 405 nm.

Development of Variable Loop Cocktail (VLC) Trimers.

Using BG505 SOSIP MD39 trimer as a base, a series of new trimers were engineered by replacing the immunodominant variable loops of the BG505 strain with loops from alternative strains. Given the vast number of HIV strains available, Applicants created three separate criteria to guide loop selection. For the first set of variable loop transplants, Applicants cataloged the number of glycans within each variable loop and the length of each variable loop (FIG. 7C). Certain combinations of variable loop lengths and glycans were observed more frequently than others across HIV strains (e.g. 20.48% of HIV strains have a 14 amino acid variable loop 2 with one glycan, FIG. 7C). Applicants searched for strains that contain the most common loop length/glycan combination for each of the variable loops (V1, V2, V4, V5). For the second set of variable loop transplants, Applicants searched for strains with variable loops of the same length and number of glycans as BG505, but with very different amino acid sequence and glycan positioning within the loops as compared to BG505. No single strain had all the same variable loop lengths and number of glycans as BG505, so Applicants relaxed criteria and matched each variable loop independently for this set of variable loop transplants only. For the third set of variable loop transplants, Applicants searched for strains with exceptionally long variable loops (V1, V2, V4 must be ≥4 amino acids longer than BG505). Under each of these criteria, Applicants were able to obtain one or two trimers that had a reasonable level of expression and formed well-behaved native-like trimers (FIG. 14A). The loops of the VLCs are defined as: VLC-1 (V1: BES10.EF363127, V2: BL8157. DQ886035, V4: BF1P51.JQ250880, V5: CZM197.DQ388515), VLC-2(BG505. DQ208458), VLC-3 (PRLS08.FJ469757) VLC-4(GHJ193.AB231897), VLC-5 (OUR2478P.EF165541). A region defined as 335-351 (HxB2) underneath V4 was included when transplanting V4, due to high variability and close contact with V4. Including BG505, Applicants report a set of 5 trimers with diverse variable loops. One version of the VLC trimers that did not have the MD39 mutations, and instead contained an extra stabilizing disulfide (DS21: V120C-Q315C) in order to staple down the tip of the V3, this version of the VLC trimers was used in an accompanying manuscript (Escolano et al., 2016).

The invention is further described by the following numbered paragraphs:

1. A non-naturally occurring protein comprising an immunogen comprising a gp120 or gp140 trimer comprising one or more stabilizing mutations, cleavage-independent modifications, and/or an anchored membrane.

2. The non-naturally occurring protein of numbered paragraph 1 comprising:

(a) a Type I or Type II immunogen, wherein the Type I immunogen is a gp120 and the Type II immunogen is a gp140 trimer molecules with one or more mutations that improve binding to germline-reverted and/or less-mutated versions of PGT121 or (b) a Type III immunogen, wherein the Type III immunogen is a gp140 trimer molecule with one or more stabilizing mutations to increase expression level and/or increase thermal melting temperature and/or improve antigenic profile, where a favorable antigenic profile means better affinity for broadly neutralizing antibodies and no or very weak affinity for non-neutralizing antibodies or (c) a Type IV immunogen, wherein the Type IV immunogen is a combination of one or more mutations from the Type II immunogen and Type III immunogen, wherein the Type IV immunogen is a gp140 trimer comprising both stabilizing mutations and germline-targeting mutations or (d) a Type V immunogen, wherein the Type V immunogen is a trimer with a modified surface or of a strain other than BG505 or (e) a Type VI immunogen, wherein the Type VI immunogen comprises one or more additional trimer modifications that add extra functionality and that can be combined with Types II, III, IV or V or (f) a Type VII immunogen, wherein the Type VIII immunogen is a native-like trimer from other HIV strains stabilized by MD39 and Olio6 mutations or (g) a Type VIII immunogen, wherein the Type VIII immunogen is a cleavage-independent trimer which is a variant of BG505 MD39 that does not require cleavage by furin or (h) a Type IX immunogen, wherein the Type IX immunogen is a glycan masked trimer in which N-linked glycosylation sites cover the bottom and sides of the soluble trimer or (i) a Type X immunogen, wherein the Type X immunogen is a native-like trimer with variable loops V1, V2b and V4 modified to minimize their lengths and maximize the number of glycosylation sites contained within them or (j) a Type XI immunogen, wherein the Type XI immunogen is a BG505 MD39-based, single-component, self-assembling nanoparticle or (k) a Type XII immunogen, wherein the Type XII immunogen is a BG505 MD39-based, membrane-bound native like trimer.

3. The non-naturally occurring protein of numbered paragraph 1 or 2, wherein the protein comprises any one of:

(a) BG505-gp120-L111A-2_T135A_T139I_mC
(BG505-gp120 3mut)
(SEQ ID NO: 1)
VWKDAETTLFCASDAKAYETEKHNVWATHACVPTDPNPQEIHLENVTEEF

NMWKNNMVEQMHTDIISAWDQSLKPCVKLTPLCVTLQCTNVANNIIDDMR

GELKNCSFNMTTELRDKKQKVYSLFYRLDVVQINENQGNRSNNSNKEYRL

INCNTSAITQACPKVSFEPIPIHYCAPAGFAILKCKDKKFNGTGPCPSVS

TVQCTHGIKPVVSTQLLLNGSLAEEEVMIRSENITNNAKNILVQFNTPVQ

INCTRPNNNTRKSIRIGPGQAFYATGDIIGDIRQAHCNVSKATWNETLGK

VVKQLRKHFGNNTIIRFANSSGGDLEVTTHSFNCGGEFFYCNTSGLFNST

WISNTSVQGSNSTGSNDSITLPCRIKQIINMWQRIGQAMYAPPIQGVIRC

VSNITGLILTRDGGSTNSTTETFRPGGGDMRDNWRSELYKYKVVKIEP (b) BG505-gp120-L111A-2_5mut_mC
(BG505-gp120 5mut)
(SEQ ID NO: 3)
VWKDAETTLFCASDAKAYETEKHNVWATHACVPTDPNPQEIHLENVTEEF

NMWKNNMVEQMHTDIISAWDQSLKPCVKLTPLCVTLQCTNYTPNLTNDMR

GELKNCSFNMTTELRDKKQKVYSLFYRLDVVQINENQGNRSNNSNKEYRL

INCNTSAITQACPKVSFEPIPIHYCAPAGFAILKCKDKKFNGTGPCPSVS

TVQCTHGIKPVVSTQLLLNGSLAEEEVMIRSENITNNAKNILVQFNTPVQ

INCTRPNNNTRKSIRIGPGQAFYATGDIIGDIRQAHCNVSKATWNETLGK

VVKQLRKHFGNNTIIRFANSSGGDLEVTTHSFNCGGEFFYCNTSGLFNST
WISNTSVQGSNSTGSNDSITLPCRIKQIINMWQRIGQAMYAPPIQGVIRC
VSNITGLILTRDGGSTNSTTETFRPGGGDMRDNWRSELYKYKVVKIEP (c) BG505-gp120-L111A-2_7mut_mC
(BG505-gp120 7mut or BG505 gp120 7MUT)
                                        (SEQ ID NO: 5)
VWKDAETTLFCASDAKAYETEKHNVWATHACVPTDPNPQEIHLENVTEEF
NMWKNNMVEQMHTDIISAWDQSLKPCVKLTPLCVTLQCTNYAPNLINDMR
GELKNCSFNMTTELRDKKQKVYSLFYRLDVVQINENQGNRSNNSNKEYRL
INCNTSAITQACPKVSFEPIPIHYCAPAGFAILKCKDKKFNGTGPCPSVS
TVQCTHGIKPVVSTQLLLNGSLAEEEVMIRSENITNNAKNILVQFNTPVQ
INCTRPNNNTRKSIRIGPGQAFYATGDIIGDIRQAHCNVSKATWNETLGK
VVKQLRKHFGNNTIIRFANSSGGDLEVTTHSFNCGGEFFYCNTSGLFNST
WISNTSVQGSNSTGSNDSITLPCRIKQIINMWQRIGQAMYAPPIQGVIRC
VSNITGLILTRDGGSTNSTTETFRPGGGDMRDNWRSELYKYKVVKIEP (d) BG505-gp120-L111A-2_10mut_mC
(BG505-gp120 10mut or BG505 gp120 10MUT)
                                        (SEQ ID NO: 7)
VWKDAETTLFCASDAKAYETEKHNVWATHACVPTDPNPQEIHLENVTEEF
NMWKNNMVEQMHTDIISAWDQSLKPCVKLTPLCVTLQCTNYAPFLINDMR
GELKNCSFNMTTELRDKKQKVYSLFYRLDVVQINENQGNRSNNSNKEYRL
INCNTSAITQACPKVSFEPIPIHYCAPAGFAILKCKDKKFNGTGPCPSVS
TVQCTHGIKPVVSTQLLLNGSLAEEEVMIRSENITNNAKNILVQFNTPVQ
INCTRPNNNTRKSIRIGPGQAFYAFGDIIGDIRMAHCNVSKATWNETLGK
VVKQLRKHFGNNTIIRFANSSGGDLEVTTHSFNCGGEFFYCNTSGLFNST
WISNTSVQGSNSTGSNDSITLPCRIKQIINMWQRIGQAMYAPPIQGVIRC
VSNITGLILTRDGGSTNSTTETFRPGGGDMRDNWRSELYKYKVVKIEP (e) BG505-gp120-L111A-2_10mut2A_mC
                                        (SEQ ID NO: 9)
VWKDAETTLFCASDAKAYETEKHNVWATHACVPTDPNPQEIHLENVTEEF
NMWKNNMVEQMHTDIISAWDQSLKPCVKLTPLCVTLQCTNYAPFLINNMR
GELKNCSFNMTTELRDKKQKVYSLFYRLDVVQINENQGNRSNNSNKEYRL
INCNTSAITQACPKVSFEPIPIHYCAPAGFAILKCKDKKFNGTGPCPSVS
TVQCTHGIKPVVSTQLLLNGSLAEEEVMIRSENITNNAKNILVQFNTPVQ
INCTRPNNNTRKSIRIGPGQAFYAFGDIIGDIRMAHCNVSKATWNETLGK
VVKQLRKHFGNNTIIRFANSSGGDLEVTTHSFNCGGEFFYCNTSGLFNST
WISNTSVQGSNSTGSNDSITLPCRIKQIINMWQRIGQAMYAPPIQGVIRC
VSNITGLILTRDGGSTNSTTETFRPGGGDMRDNWRSELYKYKVVKIEP (f) BG505-gp120-L111A-2_11mut2A_mC
                                       (SEQ ID NO: 11)
VWKDAETTLFCASDAKAYETEKHNVWATHACVPTDPNPQEIHLENVTEEF
NMWKNNMVEQMHTDIISAWDQSLKPCVKLTPLCVTLQCTNYAPNLLSNMR
GELKNCSFNMTTELRDKKQKVYSLFYRLDVVQINENQGNRSNNSNKEYRL
INCNTSAITQACPKVSFEPIPIHYCAPAGFAILKCKDKKFNGTGPCPSVS
TVQCTHGIKPVVSTQLLLNGSLAEEEVMIRSENITNNAKNILVQFNTPVQ
INCTRPNNNTRKSIRIGPGQAFYAFGDIIGDIRMAHCNVSKATWNETLGK VVKQLRKHFGNNTIIRFANSSGGDLEVTTHSFNCGGEFFYCNTSGLFNST
WISNTSVQGSNSTGSNDSIVLPCRIKQIINMWQRIGQAMYAPPIQGVIRC
VSNITGLILTRDGGSTNSTTETFRPGGGDMRDNWRSELYKYKVVKIEP 4. The non-naturally occurring protein of numbered paragraph 1 or 2r, wherein the trimer comprises any one of:

(a) BG505_SOSIP.D664_JS_3mut_mC
(SOSIP-3MUT)
                                       (SEQ ID NO: 13)
AENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQ
CTNVANNIIDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVMIRSENITNN
AKNILVQFNTPVQINCTRPNNNTRKSIRIGPGQAFYATGDIIGDIRQAHC
NVSKATWNETLGKVVKQLRKHFGNNTIIRFANSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALD (b) BG505_SOSIP.D664_JS_5mut_mC
(SOSIP-5MUT)
                                       (SEQ ID NO: 15)
AENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQ
CTNYTPNLTNDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVMIRSENITNN
AKNILVQFNTPVQINCTRPNNNTRKSIRIGPGQAFYATGDIIGDIRQAHC
NVSKATWNETLGKVVKQLRKHFGNNTIIRFANSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVFLGFLGAAGSTM
GAASMTLTVQARNLLSGIVQQQSNLLRAPEAQQHLLKLTVWGIKQLQARV
LAVERYLRDQQLLGIWGCSGKLICCTNVPWNSSWSNRNLSEIWDNMTWLQ
WDKEISNYTQIIYGLLEESQNQQEKNEQDLLALD (c) BG505_SOSIP.D664_JS_7mut_mC
(SOSIP-7MUT)
                                       (SEQ ID NO: 17)
AENLWVTVYYGVPVWKDAETTLFCASDAKAYETEKHNVWATHACVPTDPN
PQEIHLENVTEEFNMWKNNMVEQMHTDIISLWDQSLKPCVKLTPLCVTLQ
CTNYAPNLINDMRGELKNCSFNMTTELRDKKQKVYSLFYRLDVVQINENQ
GNRSNNSNKEYRLINCNTSAITQACPKVSFEPIPIHYCAPAGFAILKCKD

```
KKFNGTGPCPSVSTVQCTHGIKPVVSTQLLLNGSLAEEEVMIRSENITNN

AKNILVQFNTPVQINCTRPNNNTRKSIRIGPGQAFYATGDIIGDIRQAHC

NVSKATWNETLGKVVKQLRKHFGNNTIIRFANSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVFLGFLGAAGSTM

GAASMTLTVQARNLLSGIVQQQSNLLRAPEAQQHLLKLTVWGIKQLQARV

LAVERYLRDQQLLGIWGCSGKLICCTNVPWNSSWSNRNLSEIWDNMTWLQ

WDKEISNYTQIIYGLLEESQNQQEKNEQDLLALD (d) BG505_SOSIP.D664_JS_10mut_mC
(SOSIP-10MUT)
                                            (SEQ ID NO: 19)
AENLWVTVYYGVPVWKDAETTLFCASDAKAYETEKHNVWATHACVPTDPN

PQEIHLENVTEEFNMWKNNMVEQMHTDIISLWDQSLKPCVKLTPLCVTLQ

CTNYAPFLINDMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVMIRSENITNN

AKNILVQFNTPVQINCTRPNNNTRKSIRIGPGQAFYAFGDIIGDIRMAHC

NVSKATWNETLGKVVKQLRKHFGNNTIIRFANSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVFLGFLGAAGSTM

GAASMTLTVQARNLLSGIVQQQSNLLRAPEAQQHLLKLTVWGIKQLQARV

LAVERYLRDQQLLGIWGCSGKLICCTNVPWNSSWSNRNLSEIWDNMTWLQ

WDKEISNYTQIIYGLLEESQNQQEKNEQDLLALD (e) BG505_SOSIP.D664_JS_10mut2A_mC
                                            (SEQ ID NO: 21)
AENLWVTVYYGVPVWKDAETTLFCASDAKAYETEKHNVWATHACVPTDPN

PQEIHLENVTEEFNMWKNNMVEQMHTDIISLWDQSLKPCVKLTPLCVTLQ

CTNYAPFLINNMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVMIRSENITNN

AKNILVQFNTPVQINCTRPNNNTRKSIRIGPGQAFYAFGDIIGDIRMAHC

NVSKATWNETLGKVVKQLRKHFGNNTIIRFANSSGGDLEVTTHSFNCGGE

FFYCNTSGLFNSTWISNTSVQGSNSTGSNDSITLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVFLGFLGAAGSTM

GAASMTLTVQARNLLSGIVQQQSNLLRAPEAQQHLLKLTVWGIKQLQARV

LAVERYLRDQQLLGIWGCSGKLICCTNVPWNSSWSNRNLSEIWDNMTWLQ

WDKEISNYTQIIYGLLEESQNQQEKNEQDLLALD (f) BG505_SOSIP.D664_JS_11mut2A_mC
                                            (SEQ ID NO: 23)
AENLWVTVYYGVPVWKDAETTLFCASDAKAYETEKHNVWATHACVPTDPN

PQEIHLENVTEEFNMWKNNMVEQMHTDIISLWDQSLKPCVKLTPLCVTLQ

CTNYAPNLLSNMRGELKNCSFNMTTELRDKKQKVYSLFYRLDVVQINENQ

GNRSNNSNKEYRLINCNTSAITQACPKVSFEPIPIHYCAPAGFAILKCKD

KKFNGTGPCPSVSTVQCTHGIKPVVSTQLLLNGSLAEEEVMIRSENITNN

AKNILVQFNTPVQINCTRPNNNTRKSIRIGPGQAFYAFGDIIGDIRMAHC

NVSKATWNETLGKVVKQLRKHFGNNTIIRFANSSGGDLEVTTHSFNCGGE

FFYCNTSGLFNSTWISNTSVQGSNSTGSNDSIVLPCRIKQIINMWQRIGQ

AMYAPPIQGVIRCVSNITGLILTRDGGSTNSTTETFRPGGGDMRDNWRSE

LYKYKVVKIEPLGVAPTRCKRRVVGRRRRRRAVGIGAVFLGFLGAAGSTM

GAASMTLTVQARNLLSGIVQQQSNLLRAPEAQQHLLKLTVWGIKQLQARV

LAVERYLRDQQLLGIWGCSGKLICCTNVPWNSSWSNRNLSEIWDNMTWLQ

WDKEISNYTQIIYGLLEESQNQQEKNEQDLLALD
```

5. The non-naturally occurring protein of numbered paragraph 1 or 2, wherein the trimer comprises any one of:

```
(a) BG505_SOSIP_D664_MD39_mC (BG505 SOSIP-MD39 or MD39)
                                            (SEQ ID NO: 25)
AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNVTNNIT

DDMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCPSVSTVQCTHGIKPVVS

TQLLLNGSLAEEEVIIRSENITNNAKNILVQLNTPVQINCTRPNNNTVKSIRIGPGQAFY

YTGDIIGDIRQAHCNVSKATWNETLGKVVKQLRKHFGNNTIIRFAQSSGGDLEVTTHS

FNCGGEFFYCNTSGLFNSTWISNTSVQGSNSTGSNDSITLPCRIKQIINMWQRIGQAMY

APPIQGVIRCVSNITGLILTRDGGSTNSTTETFRPGGGDMRDNWRSELYKYKVVKIEPL

GVAPTRCKRRVVGRRRRRRAVGIGAVSLGFLGAAGSTMGAASMTLTVQARNLLSGIV

QQQSNLLRAPEPQQHLLKDTHWGIKQLQARVLAVEHYLRDQQLLGIWGCSGKLICCT

NVPWNSSWSNRNLSEIWDNMTWLQWDKEISNYTQIIYGLLEESQNQQEKNEQDLLALD
```

(b) BG505_SOSIP_D664_MD16_mC stabilizes the V3 loop
(SEQ ID NO: 27)
AENLWVTVYYGVPVWKDAETTLFCASDAKAYETEKHNVWATHACVPTDPNPQ

EIHLENVTEEFNMWKNNMVEQMHTDIISLWDQSLKPCVKLTPLCVTLQCTNVTNNIT

DDMRGELKNCSFNMTTELRDKKQKVYSLFYRLDVVQINENQGNRSNNSNKEYRLINC

NTSAITQACPKVSFEPIPIHYCAPAGWAILKCKDKKFNGTGPCPSVSTVQCTHGIKPVV

STQLLLNGSLAEEEVMIRSENITNNAKNILVQFNTPVQINCTRPNNNTVKSIRIGPGQAF

YYTGDIIGDIRQAHCNVSKATWNETLGKVVKQLRKHFGNNTIIRFANSSGGDLEVTTH

SFNCGGEFFYCNTSGLFNSTWISNTSVQGSNSTGSNDSITLPCRIKQIINMWQRIGQAM

YAPPIQGVIRCVSNITGLILTRDGGSTNSTTETFRPGGGDMRDNWRSELYKYKVVKIEP

LGVAPTRCKRRVVGRRRRRRAVGIGAVFLGFLGAAGSTMGAASMTLTVQARNLLSGI

VQQQSNLLRAPEAQQHLLKDTVWGIKQLQARVLAVERYLRDQQLLGIWGCSGKLICC

TNVPWNSSWSNRNLSEIWDNMTWLQWDKEISNYTQIIYGLLEESQNQQEKNEQDLLA

LD (c) BG505_SOSIP_D664_split1_1_mC increases melting temp 10 C.
(SEQ ID NO: 29)
AENLWVTVYYGVPVWKDAETTLFCASDAKAYETEKHNVWATHECVPTDPNPQ

EIHLENVTEEFNMWKNNMVEQMHTDIIELWDQSLKPCVKLTPLCVTLQCTNVTNNIT

DDMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCPSVSTVQCTHGIKPVVS

TQLLLNGSLAEEEVMIRSENITNNAKNILVQFNTPVQINCTRPNNNTRKSIRIGPGQAFY

ATGDIIGDIRQAHCNVSKATWNETLGKVVKQLRKHFGNNTIIRFANSSGGDLEVTTHS

FNCGGEFFYCNTSGLFNSTWISNTSVQGSNSTGSNDSITLPCRIKQIINMWQRIGQAMY

APPIQGVIRCVSNITGLILTRDGGSTNSTTETFRPGGGDMRDNWRSELYKYKVVKIEPL

GVAPTRCKRRVVGRRRRRRAVGIGAVFLGFLGAAGSTMGAASMTLTVQARNLLSGIV

QQQSNLLRAPEAQQHLLKLTVWGIKQLQARVLAVERYLRDQQLLGIWGCSGKLICCT

NVPWNSSWSNRNLSEIWDNMTWLQWDKEISNYTQIIYGLLEESQNQQEKNEQDLLALD (d) BG505_SOSIP_D664_MD39C_mC highest melting temp 82.5 C.
(SEQ ID NO: 31)
AENLWVTVYYGVPVWKDAETTLFCASDAKAYETEKHNVWATHECVPTDPNPQ

EIHLENVTEEFNMWKNNMVEQMHTDIIELWDQSLKPCVKLTPLCVTLQCTNVTNNIT

DDMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCPSVSTVQCTHGIKPVVS

TQLLLNGSLAEEEVIIRSENITNNAKNILVQLNTPVQINCTRPNNNTVKSIRIGPGQAFY

YTGDIIGDIRQAHCNVSKATWNETLGKVVKQLRKHFGNNTIIRFAQSSGGDLEVTTHS

FNCGGEFFYCNTSGLFNSTWISNTSVQGSNSTGSNDSITLPCRIKQIINMWQRIGQAMY

APPIQGVIRCVSNITGLILTRDGGSTNSTTETFRPGGGDMRDNWRSELYKYKVVKIEPL

GVAPTRCKRRVVGRRRRRRAVGIGAVSLGFLGAAGSTMGAASMTLTVQARNLLSGIV

QQQSNLLRAPEPQQHLLKLTVWGIKQLQARVLAVEHYLRDQQLLGIWGCSGKLICCT

NVPWNSSWSNRNLSEIWDNMTWLQWDKEISNYTQIIYGLLEESQNQQEKNEQDLLALD (e) BG505_SOSIP_D664_MD9_mC improved yield/stability
(SEQ ID NO: 33)
AENLWVTVYYGVPVWKDAETTLFCASDAKAYETEKHNVWATHACVPTDPNPQ

EIHLENVTEEFNMWKNNMVEQMHTDIISLWDQSLKPCVKLTPLCVTLQCTNVTNNIT

-continued

DDMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCPSVSTVQCTHGIKPVVS

TQLLLNGSLAEEEVMIRSENITNNAKNILVQFNTPVQINCTRPNNNTRKSIRIGPGQAFY

ATGDIIGDIRQAHCNVSKATWNETLGKVVKQLRKHFGNNTIIRFANSSGGDLEVTTHS

FNCGGEFFYCNTSGLFNSTWISNTSVQGSNSTGSNDSITLPCRIKQIINMWQRIGQAMY

APPIQGVIRCVSNITGLILTRDGGSTNSTTETFRPGGGDMRDNWRSELYKYKVVKIEPL

GVAPTRCKRRVVGRRRRRRAVGIGAVFLGFLGAAGSTMGAASMTLTVQARNLLSGIV

QQQSNLLRAPERQQHLLKDTVWGIKQLQARVLAVEHYLRDQQLLGIWGCSGKLICCT

NVPWNSSWSNRNLSEIWDNMTWLQWDKEISNYTQIIYGLLEESQNQQEKNEQDLLALD (f) BG505_SOSIP_D664_MD2_mC improved yield
(SEQ ID NO: 35)
AENLWVTVYYGVPVWKDAETTLFCASDAKAYETEKHNVWATHACVPTDPNPQ

EIHLENVTEEFNMWKNNMVEQMHTDIISLWDQSLKPCVKLTPLCVTLQCTNVTNNIT

DDMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCPSVSTVQCTHGIKPVVS

TQLLLNGSLAEEEVMIRSENITNNAKNILVQFNTPVQINCTRPNNNTRKSIRIGPGQAFY

ATGDIIGDIRQAHCNVSKATWNETLGKVVKQLRKHFGNNTIIRFANSSGGDLEVTTHS

FNCGGEFFYCNTSGLFNSTWISNTSVQGSNSTGSNDSITLPCRIKQIINMWQRIGQAMY

APPIQGVIRCVSNITGLILTRDGGSTNSTTETFRPGGGDMRDNWRSELYKYKVVKIEPL

GVAPTRCKRRVVGRRRRRRAVGIGAVFLGFLGAAGSTMGAASMTLTVQARNLLSGIV

QQQSNLLRAPEAQQHLLKDTVWGIKQLQARVLAVERYLRDQQLLGIWGCSGKLICCT

NVPWNSSWSNRNLSEIWDNMTWLQWDKEISNYTQIIYGLLEESQNQQEKNEQDLLALD (g) BG505_SOSIP_D664_olio6_mC
(SEQ ID NO: 37)
AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNVTNNIT

DDMRGELKNCSFNMTTELRDKKQKVYSLFWRLDVVQINENQGNRSNNSNKEYRLIN

CNTSAITQACPKVSFEPIPIHYCAPAGFAILKCKDKKFNGTGPCPSVSTVQCTHGIKPVV

STQLLLNGSLAEEEVIIRSENITNNAKNILVQLNTPVQINCTAPNNFTVKSIRIGPGQAFY

YMGDIIGDIRQAHCNVSKATWNETLGKVVKQLRKHFGNNTIIRFAQSSGGDLEVTTHS

FNCGGMFFYCNTSGLFNSTWISNTSVQGSNSTGSNDSITLPCRIKLIINMWQRIGQAMY

APPIQGVIRCVSNITGLILTRDGGSTNSTTETFRPGGGDMRDNWRSELYKYKVVKIEPL

GVAPTRCKRRVVGRRRRRRAVGIGAVSLGFLGAAGSTMGAASMTLTVQARNLLSGIV

QQQSNLLRAPEPQQHLLKDTHWGIKQLQARVLAVEHYLRDQQLLGIWGCSGKLICCT

NVPWNSSWSNRNLSEIWDNMTWLQWDKEISNYTQIIYGLLEESQNQQEKNEQDLLALD (h) BG505_SOSIP_D664_MD53_mC
(SEQ ID NO: 39)
AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNVTNNIT

DDMRGELKNCSFNMTTELRDKKQKVYSLFWRLDVVQINENQGNRSNNSNKEYRLIN

CNTSAITQACPKVSFEPIPIHYCAPAGFAILKCKDKKFNGTGPCPSVSTVQCTHGIKPVL

STQLLLNGSLAEEEVIVRSENITNNAKNILVQLNTPVQINCTAPNNFTVKSIRIGPGQAF

YYMGDIIGDIRQAHCNVSKATWNETLGKVVKQLRKHFGNNTIIRFAQSSGGDLEVTTH

SFNCGGMFFFCNTSGLFNSTWISNTSVQGSNSTGSNDSITLPCRIKLIINMWQRIGQAM

YAPPIQGVIRCVSNITGLILTRDGGSTNSTTETFRPGGGDMRDVWRSELYKYKVVKIEP

LGVAPTRCKRRVVGRRRRRAVGIGAVSLGFLGAAGSTMGAASMTLTVQARNLLSGI

VQQQSNLLRAPEPQQHLLKDTHWGIKQLQARVLAVEHYLRDQQLLGIWGCSGKLICC

TNVPWNSSWSNRNLSEIWDNMTWLQWDKEISNYTQIIYGLLEESQNQQEKNEQDLLA

LD (i) BG505_SOSIP_D664_MD37

(SEQ ID NO: 164)

AENLWVTVYYGVPVWKDAETTLFCASDAKAYETEKHNVWATHACVPTDPNPQ

EIHLENVTEEFNMWKNNMVEQMHEDIISLWDQSLKPC<u>C</u>KLTPLCVTLQCTNVTNNIT

DDMRGELKNCSFNMTTELRDKKQKVYSLFYRLDVVQINENQGNRSNNSNKEYRLINC

NTSACTQACPKVSFEPIPIHYCAPAGFAILKCKDKKFNGTGPCPSVSTVQCTHGIKPVVS

TQLLLNGSLAEEEVIIRSENITNNAKNILVQLNTPVQINCTRPNNNTRKSIRIGPGCAFY

ATGDIIGDIRQAHCNVSKATWNETLGKVVKQLRKHFGNNTIIRFAQSSGGDLEVTTHS

FNCGGEFFYCNTSGLFNSTWISNTSVQGSNSTGSNDSITLPCRIKQIINMWQRIGQCMY

APPIQGVIRCVSNITGLILTRDGGSTNSTTETFRPGGGDMRDNWRSELYKYKVVKIEPL

GVAPTRCKRRVVGRRRRRAVGIGAVSLGFLGAAGSTMGAASMTLTVQARNLLSGIV

QQQSNLLRAPEPQEHLHKDTHWGIKQLQARVLAVEHYLRDQQLLGIWGCSGKLICCT

NVPWNSSWSNRNLSEIWDNMTWLQWDKEISNYTQIIYGLLEESQNQQEKNEQDLLALD 30
 6. A The non-naturally occurring protein of numbered paragraph 1 or 2, wherein the trimer comprises any one of:

(a) BG505_SOSIP_D664_MD39_9mut2A_mC (MD39 + 9MUT)

(SEQ ID NO: 42)

AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNYAPFLI

NNMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCPSVSTVQCTHGIKPVVS

TQLLLNGSLAEEEVIIRSENITNNAKNILVQLNTPVQINCTRPNNNTVKSIRIGPGQAFY

YTGDIIGDIRMAHCNVSKATWNETLGKVVKQLRKHFGNNTIIRFAQSSGGDLEVTTHS

FNCGGEFFYCNTSGLFNSTWISNTSVQGSNSTGSNDSITLPCRIKQIINMWQRIGQAMY

APPIQGVIRCVSNITGLILTRDGGSTNSTTETFRPGGGDMRDNWRSELYKYKVVKIEPL

GVAPTRCKRRVVGRRRRRAVGIGAVSLGFLGAAGSTMGAASMTLTVQARNLLSGIV

QQQSNLLRAPEPQQHLLKDTHWGIKQLQARVLAVEHYLRDQQLLGIWGCSGKLICCT

NVPWNSSWSNRNLSEIWDNMTWLQWDKEISNYTQIIYGLLEESQNQQEKNEQDLLALD (b) BG505_SOSIP_D664_MD39_10mut_mC (SEQ ID NO: 44)

AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNYAPFLI

NDMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCPSVSTVQCTHGIKPVVS

TQLLLNGSLAEEEVIIRSENITNNAKNILVQLNTPVQINCTRPNNNTVKSIRIGPGQAFY

YFGDIIGDIRMAHCNVSKATWNETLGKVVKQLRKHFGNNTIIRFAQSSGGDLEVTTHS

FNCGGEFFYCNTSGLFNSTWISNTSVQGSNSTGSNDSITLPCRIKQIINMWQRIGQAMY

-continued

```
APPIQGVIRCVSNITGLILTRDGGSTNSTTETFRPGGGDMRDNWRSELYKYKVVKIEPL

GVAPTRCKRRVVGRRRRRAVGIGAVSLGFLGAAGSTMGAASMTLTVQARNLLSGIV

QQQSNLLRAPEPQQHLLKDTHWGIKQLQARVLAVEHYLRDQQLLGIWGCSGKLICCT

NVPWNSSWSNRNLSEIWDNMTWLQWDKEISNYTQIIYGLLEESQNQQEKNEQDLLALD
```

(c) BG505_SOSIP_D664_MD39_10mut2A_mC
(SEQ ID NO: 46)

```
AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNYAPFLI

NNMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCPSVSTVQCTHGIKPVVS

TQLLLNGSLAEEEVIIRSENITNNAKNILVQLNTPVQINCTRPNNNTVKSIRIGPGQAFY

YFGDIIGDIRMAHCNVSKATWNETLGKVVKQLRKHFGNNTIIRFAQSSGGDLEVTTHS

FNCGGEFFYCNTSGLFNSTWISNTSVQGSNSTGSNDSITLPCRIKQIINMWQRIGQAMY

APPIQGVIRCVSNITGLILTRDGGSTNSTTETFRPGGGDMRDNWRSELYKYKVVKIEPL

GVAPTRCKRRVVGRRRRRAVGIGAVSLGFLGAAGSTMGAASMTLTVQARNLLSGIV

QQQSNLLRAPEPQQHLLKDTHWGIKQLQARVLAVEHYLRDQQLLGIWGCSGKLICCT

NVPWNSSWSNRNLSEIWDNMTWLQWDKEISNYTQIIYGLLEESQNQQEKNEQDLLALD
```

(d) BG505_SOSIP_D664_MD39_11mut2A_mC
(SEQ ID NO: 48)

```
AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNYAPNLL

SNMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCPSVSTVQCTHGIKPVVS

TQLLLNGSLAEEEVIIRSENITNNAKNILVQLNTPVQINCTRPNNNTVKSIRIGPGQAFY

YFGDIIGDIRMAHCNVSKATWNETLGKVVKQLRKHFGNNTIIRFAQSSGGDLEVTTHS

FNCGGEFFYCNTSGLFNSTWISNTSVQGSNSTGSNDSIVLPCRIKQIINMWQRIGQAMY

APPIQGVIRCVSNITGLILTRDGGSTNSTTETFRPGGGDMRDNWRSELYKYKVVKIEPL

GVAPTRCKRRVVGRRRRRAVGIGAVSLGFLGAAGSTMGAASMTLTVQARNLLSGIV

QQQSNLLRAPEPQQHLLKDTHWGIKQLQARVLAVEHYLRDQQLLGIWGCSGKLICCT

NVPWNSSWSNRNLSEIWDNMTWLQWDKEISNYTQIIYGLLEESQNQQEKNEQDLLALD
```

7. The non-naturally occurring protein of numbered paragraph 1 or 2, that can be employed in strategic boosting regimens, wherein the trimer comprises any one of:

(a) BG505_SOSIP_MD39_VLC1-03
(SEQ ID NO: 50)

```
AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTDWDNAT

LANMTGEIKNCSFNMTTELRDKKQKVYSLFYELDIIPIENEYISNNNTSNTSYRLINC

NTSAITQACPKVSFEPIPIHYCAPAGFAILKCKDKKFNGTGPCPSVSTVQCTHGIKPVVS

TQLLLNGSLAEEEVIIRSENITNNAKNILVQLNTPVQINCTRPNNNTVKSIRIGPGQAFY

YTGDIIGDIRQAHCNVSATQWEQTLKGIAAKLLEHFGNNTIIRFAQSSGGDLEVTTHS

FNCGGEFFYCNTSGLFNGSSWNLNKTKENTTNLENGTITLPCRIKQIINMWQRIGQA

MYAPPIQGVIRCVSNITGLILTRDGGNKSAGIETFRPGGGDMRDNWRSELYKYKVVKI
```

-continued

EPLGVAPTRCKRRVVGRRRRRAVGIGAVSLGFLGAAGSTMGAASMTLTVQARNLLS

GIVQQQSNLLRAPEPQQHLLKDTHWGIKQLQARVLAVEHYLRDQQLLGIWGCSGKLI

CCTNVPWNSSWSNRNLSEIWDNMTWLQWDKEISNYTQIIYGLLEESQNQQEKNEQDL

LALD (b) BG505_SOSIP_MD39_VLC2-04

(SEQ ID NO: 52)

AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCSDYEGNTT

RQNITMKEEKGEIKNCSFNMTTELRDKKQKVYSLFYKLDITPIEEDNNSNNSSSANS

SNSNANYTNYRLINCNTSAITQACPKVSFEPIPIHYCAPAGFAILKCKDKKFNGTGPCPS

VSTVQCTHGIKPVVSTQLLLNGSLAEEEVIIRSENITNNAKNILVQLNTPVQINCTRPNN

NTVKSIRIGPGQAFYYTGDIIGDIRQAHCNVSGTKWKNTLKQIVKKLGDHFGNNTIIRF

AQSSGGDLEVTTHSFNCGGEFFYCNTSGLFNSTWNRTNGTWNDVEGLNYTNGNDTI

TLPCRIKQIINMWQRIGQAMYAPPIQGVIRCVSNITGLILTRDGGNDTDKNETFRPGGG

DMRDNWRSELYKYKVVKIEPLGVAPTRCKRRVVGRRRRRAVGIGAVSLGFLGAAG

STMGAASMTLTVQARNLLSGIVQQQSNLLRAPEPQQHLLKDTHWGIKQLQARVLAVE

HYLRDQQLLGIWGCSGKLICCTNVPWNSSWSNRNLSEIWDNMTWLQWDKEISNYTQI

IYGLLEESQNQQEKNEQDLLALD (c) BG505_SOSIP_MD39_VLC2-08

(SEQ ID NO: 54)

AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCVTLKNCSN

SNCSISRNISIEMDGEIKNCSFNMTTELRDKKQKVYSLFYRLDIVPIESSNNSQLSNNS

QVSNNSQSSNYSQYRLINCNTSAITQACPKVSFEPIPIHYCAPAGFAILKCKDKKFNGT

GPCPSVSTVQCTHGIKPVVSTQLLLNGSLAEEEVIIRSENITNNAKNILVQLNTPVQINCT

RPNNNTVKSIRIGPGQAFYYTGDIIGDIRQAHCNVSKKDWEKTLQQVATKLGQHFGN

NTIIRFAQSSGGDLEVTTHSFNCGGEFFYCNTSGLFNSTWIRNSSNSTWNSSASNSTEL

NSNITLPCRIKQIINMWQRIGQAMYAPPIQGVIRCVSNITGLILTRDGGHETENKTETFR

PGGGDMRDNWRSELYKYKVVKIEPLGVAPTRCKRRVVGRRRRRAVGIGAVSLGFL

GAAGSTMGAASMTLTVQARNLLSGIVQQQSNLLRAPEPQQHLLKDTHWGIKQLQAR

VLAVEHYLRDQQLLGIWGCSGKLICCTNVPWNSSWSNRNLSEIWDNMTWLQWDKEI

SNYTQIIYGLLEESQNQQEKNEQDLLALD (d) BG505_SOSIP_MD39_VLC3-13

(SEQ ID NO: 56)

AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNAALTNV

TITNGPNITEEIRNCSFNMTTELRDKKQKVYSLFYKLDLVQINGSGGEYRLINCNTSA

ITQACPKVSFEPIPIHYCAPAGFAILKCKDKKFNGTGPCPSVSTVQCTHGIKPVVSTQLL

LNGSLAEEEVIIRSENITNNAKNILVQLNTPVQINCTRPNNNTVKSIRIGPGQAFYYTGDI

IGDIRQAHCNVSGTKWNETLKQVAGKLRKHFGNNTIIRFAQSSGGDLEVTTHSFNCG

GEFFYCNTSGLFNSTWPENGTMEGSNGTITLPCRIKQIINMWQRIGQAMYAPPIQGVI

RCVSNITGLILTRDGGNSTTDTETFRPGGGDMRDNWRSELYKYKVVKIEPLGVAPTRC

KRRVVGRRRRRAVGIGAVSLGFLGAAGSTMGAASMTLTVQARNLLSGIVQQQSNLL

-continued

RAPEPQQHLLKDTHWGIKQLQARVLAVEHYLRDQQLLGIWGCSGKLICCTNVPWNSS

WSNRNLSEIWDNMTWLQWDKEISNYTQIIYGLLEESQNQQEKNEQDLLALD (e) BG50_5SOSIP_VLC1-03_D521_mC (SEQ ID NO : 58)

AENLWVTVYYGVPVWKDAETTLFCASDAKAYETEKHNVWATHACVPTDPNPQ

EIHLENVTEEFNMWKNNMVEQMHTDIISLWDQSLKPCCKLTPLCVTLQCTDWDNATL

ANMTGEIKNCSFNMTTELRDKKQKVYSLFYELDIIPIENEYISNNNTSNTSYRLINCNTS

AITQACPKVSFEPIPIHYCAPAGFAILKCKDKKFNGTGPCPSVSTVQCTHGIKPVVSTQL

LLNGSLAEEEVMIRSENITNNAKNILVQFNTPVQINCTRPNNNTRKSIRIGPGCAFYATG

DIIGDIRQAHCNVSATQWEQTLKGIAAKLLEHFGNNTIIRFANSSGGDLEVTTHSFNCG

GEFFYCNTSGLFNGSSWNLNKTKENTTNLENGTITLPCRIKQIINMWQRIGQAMYAPPI

QGVIRCVSNITGLILTRDGGNKSAGIETFRPGGGDMRDNWRSELYKYKVVKIEPLGVA

PTRCKRRVVGRRRRRRAVGIGAVFLGFLGAAGSTMGAASMTLTVQARNLLSGIVQQQ

SNLLRAPEAQQHLLKLTVWGIKQLQARVLAVERYLRDQQLLGIWGCSGKLICCTNVP

WNSSWSNRNLSEIWDNMTWLQWDKEISNYTQIIYGLLEESQNQQEKNEQDLLALD (f) BG505_SOSIP_VLC2-04_DS21_mC (SEQ ID NO: 60)

AENLWVTVYYGVPVWKDAETTLFCASDAKAYETEKHNVWATHACVPTDPNPQ

EIHLENVTEEFNMWKNNMVEQMHTDIISLWDQSLKPCCKLTPLCVTLQCSDYEGNTT

RQNITMKEEKGEIKNCSFNMTTELRDKKQKVYSLFYKLDITPIEEDNNSNNSSSANSSN

SNANYTNYRLINCNTSAITQACPKVSFEPIPIHYCAPAGFAILKCKDKKFNGTGPCPSVS

TVQCTHGIKPVVSTQLLLNGSLAEEEVMIRSENITNNAKNILVQFNTPVQINCTRPNNN

TRKSIRIGPGCAFYATGDIIGDIRQAHCNVSGTKWKNTLKQIVKKLGDHFGNNTIIRFA

NSSGGDLEVTTHSFNCGGEFFYCNTSGLFNSTWNRTNGTWNDVEGLNYTNGNDTITL

PCRIKQIINMWQRIGQAMYAPPIQGVIRCVSNITGLILTRDGGNDTDKNETFRPGGGDM

RDNWRSELYKYKVVKIEPLGVAPTRCKRRVVGRRRRRRAVGIGAVFLGFLGAAGSTM

GAASMTLTVQARNLLSGIVQQQSNLLRAPEAQQHLLKLTVWGIKQLQARVLAVERYL

RDQQLLGIWGCSGKLICCTNVPWNSSWSNRNLSEIWDNMTWLQWDKEISNYTQIIYG

LLEESQNQQEKNEQDLLALD (g) BG505_SOSIP_VLC2-08_DS21_mC (SEQ ID NO: 62)

AENLWVTVYYGVPVWKDAETTLFCASDAKAYETEKHNVWATHACVPTDPNPQ

EIHLENVTEEFNMWKNNMVEQMHTDIISLWDQSLKPCCKLTPLCVTLKNCSN

SNCSISRNISIEMDGEIKNCSFNMTTELRDKKQKVYSLFYRLDIVPIESSNNSQLSNNSQ

VSNNSQSSNYSQYRLINCNTSAITQACPKVSFEPIPIHYCAPAGFAILKCKDKKFNGTGP

CPSVSTVQCTHGIKPVVSTQLLLNGSLAEEEVMIRSENITNNAKNILVQFNTPVQINCTR

PNNNTRKSIRIGPGCAFYATGDIIGDIRQAHCNVSKKDWEKTLQQVATKLGQHFGNNT

IIRFANSSGGDLEVTTHSFNCGGEFFYCNTSGLFNSTWIRNSSNSTWNSSASNSTELNSN

ITLPCRIKQIINMWQRIGQAMYAPPIQGVIRCVSNITGLILTRDGGHETENKTETFRPGG

GDMRDNWRSELYKYKVVKIEPLGVAPTRCKRRVVGRRRRRRAVGIGAVFLGFLGAA

GSTMGAASMTLTVQARNLLSGIVQQQSNLLRAPEAQQHLLKLTVWGIKQLQARVLA

VERYLRDQQLLGIWGCSGKLICCTNVPWNSSWSNRNLSEIWDNMTWLQWDKEISNY

TQIIYGLLEESQNQQEKNEQDLLALD

-continued (h) BG505_SOSIP_VLC3-13_DS21_mC (SEQ ID NO: 64)

AENLWVTVYYGVPVWKDAETTLFCASDAKAYETEKHNVWATHACVPTDPNPQ

EIHLENVTEEFNMWKNNMVEQMHTDIISLWDQSLKPCCKLTPLCVTLQCTNAALTNV

TITNGPNITEEIRNCSFNMTTELRDKKQKVYSLFYKLDLVQINGSGGEYRLINCNTSAIT

QACPKVSFEPIPIHYCAPAGFAILKCKDKKFNGTGPCPSVSTVQCTHGIKPVVSTQLLLN

GSLAEEEVMIRSENITNNAKNILVQFNTPVQINCTRPNNNTRKSIRIGPGCAFYATGDII

GDIRQAHCNVSGTKWNETLKQVAGKLRKHFGNNTIIRFANSSGGDLEVTTHSFNCGG

EFFYCNTSGLFNSTWPENGTMEGSNGTITLPCRIKQIINMWQRIGQAMYAPPIQGVIRC

VSNITGLILTRDGGNSTTDTETFRPGGGDMRDNWRSELYKYKVVKIEPLGVAPTRCKR

RVVGRRRRRRAVGIGAVFLGFLGAAGSTMGAASMTLTVQARNLLSGIVQQQSNLLRA

PEAQQHLLKLTVWGIKQLQARVLAVERYLRDQQLLGIWGCSGKLICCTNVPWNSSWS

NRNLSEIWDNMTWLQWDKEISNYTQIIYGLLEESQNQQEKNEQDLLALD (i) AC10_SOSIP_olio6_mC (SEQ ID NO: 66)

AVEQTWVTVYYGVPVWKEANTTLFCASDAKAYNTEVHNVWATHACVPTDPNP

QEVELENVTENFNMWKNNMVDQMHEDIISLWDQSLKPCVKLTPLCVTLSCTDNVGN

DTSTNNSRWDKMEKGEIKNCSFNITTNMRDKMQKQYALFWKLDVVPIEEGKNNNSSF

TDYRLISCNTSVITQACPKVTFEPIPIHYCAPAGFALLKCKDKKFNGTGPCKNVSTVQC

THGIKPVVSTQLLLNGSLAEEEVIRSENFSNNARTIIVQLNTSVEIKCIAPNNFTVKGIH

IGPGRAFYYMGDIIGDIRQAHCNISRQNWNNTLKQIAEKLREQFGNKTIVFRQSSGGDP

EIVMHTFNCAGMFFYCNTAELFNSTWYANGTISIGGGNKTNIILPCRIKLFINMWQEVG

KAMYAPPISGQIRCSSNITGLLLTRDGGRGNQTDNQTEIFRPVGGDMKNNWRSELYKY

KVVRIEPLGIAPTRCKRRVVGRRRRRRAVGIGALSLGFLGAAGSTMGAASMTLTVQA

RLLLSGIVQQQNNLLRAPEPQQHLLQDTHWGIKQLQARVLAVEHYLRDQQLLGIWGC

SGKLICCTAVPWNVSWNNRSVDDIWENMTWMQWDREISNYTSLIYTLIEESQNQQEK

NEQELLALD (j) BG505_SOSIP_SET224_4_mC(BG505_SOSIP_R4_mC)

(SEQ ID NO: 68)

AENLWVTVYYGVPVWKDAETTLFCASDAKAYSTEKHNVWATHACVPTDPNPQ

EVVLENVTENFNMWKNNMVEQMHEDIISLWDQSLKPCVKLTPLCVTLNCTELNDTN

TTATNSSGRVIEDKEIKNCSFNMTTSLRDKVQRVYSLFNKFDIVPIDNSNDSYRLISCN

TSAITQACPKVSFEPIPIHYCAPAGFAILKCNDKEFNGTGPCKSVSTVQCTHGIRPVVST

QLLLNGSLAEEEVIIRSENFTNNAKTILVQLNEPVVINCTRPNNNTVKSIRIGPGQAFYY

TGEIIGDIRQAHCTVSRETWNKTLGRVVEQLREQFRNKTIIVFNQSSGGDPEIVMHSF

NCGGEFFYCNSTQLFNSTWYGNETETGGTNDTIGNITLPCRIKQIINMWQEVGKAMY

APPIRGQISCSSNITGLILTRDGGNNNETNTTETFRPGGGDMRDNWRSELYKYKVVKIE

PLGVAPTKCKRRVVGRRRRRRAVGIGAMSLGFLGAAGSTMGAASLTLTVQARNLLS

GIVQQQSNLLRAPEPQQHLLKDTHWGIKQLQARVLAVEHYLRDQQLLGIWGCSGKLI

CCTNVPWNTSWSNKSLDQIWDNMTWLEWDREISNYTQLIYNLLEESQNQQEKNEQD

LLALD

8. The non-naturally occurring protein of numbered paragraph 1 or 2, wherein the trimer comprises any one of:

(a) BG505_SOSIP_MD39_congly_mC
(SEQ ID NO: 70)
AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNVTNNIT

DDMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCQNVSTVQCTHGIKPVVS

TQLLLNGSLAEEEVIIRSENITNNAKNILVQLNTSVQINCTRPNNNTVKSIRIGPGQAFY

YTGDIIGDIRQAHCNVSKATWNETLGKVVKQLRKHFGNNTIIRFAQSSGGDLEVTTHS

FNCGGEFFYCNTSGLFNSTWISNTSVQGSNSTGSNDSITLPCRIKQIINMWQRIGQAMY

APPIQGVIRCVSNITGLILTRDGGSTNSTTETFRPGGGDMRDNWRSELYKYKVVKIEPL

GVAPTRCKRRVVGRRRRRRAVGIGAVSLGFLGAAGSTMGAASMTLTVQARNLLSGIV

QQQSNLLRAPEPQQHLLKDTHWGIKQLQARVLAVEHYLRDQQLLGIWGCSGKLICCT

NVPWNSSWSNRNLSEIWDNMTWLQWDKEISNYTQIIYGLLEESQNQQEKNEQDLLALD (b) BG505_SOSIP_MD39_CtCys_mC
(SEQ ID NO: 72)
AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNVTNNIT

DDMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCPSVSTVQCTHGIKPVVS

TQLLLNGSLAEEEVIIRSENITNNAKNILVQLNTPVQINCTRPNNNTVKSIRIGPGQAFY

YTGDIIGDIRQAHCNVSKATWNETLGKVVKQLRKHFGNNTIIRFAQSSGGDLEVTTHS

FNCGGEFFYCNTSGLFNSTWISNTSVQGSNSTGSNDSITLPCRIKQIINMWQRIGQAMY

APPIQGVIRCVSNITGLILTRDGGSTNSTTETFRPGGGDMRDNWRSELYKYKVVKIEPL

GVAPTRCKRRVVGRRRRRRAVGIGAVSLGFLGAAGSTMGAASMTLTVQARNLLSGIV

QQQSNLLRAPEPQQHLLKDTHWGIKQLQARVLAVEHYLRDQQLLGIWGCSGKLICCT

NVPWNSSWSNRNLSEIWDNMTWLQWDKEISNYTQIIYGLLEESQNQQEKNEQDLLAL

DGTKHHHHHHC (c) BG505_SOSIP_MD39_CD4KO4_mC
(SEQ ID NO: 74)
AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNVTNNIT

DDMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCPSVSTVQCTHGIKPVVS

TQLLLNGSLAEEEVIIRSENITNNAKNILVQLNTPVQINCTRPNNNTVKSIRIGPGQAFY

YTGDIIGDIRQAHCNVSKATWNETLGKVVKQLRKHFGNNTIIRFAQSSGGDLEVTTHS

FNCGGEFFYCNTSGLFNSTWISNTSVQGSNSTGSNDSITLPCRIKQIINMWQRIGQAMY

APPIQGVIRCVSNITGLILTRDGGSTNSTTETFRPGGTDMRDNWRSELYKYKVVKIEPL

GVAPTRCKRRVVGRRRRRRAVGIGAVSLGFLGAAGSTMGAASMTLTVQARNLLSGIV

QQQSNLLRAPEPQQHLLKDTHWGIKQLQARVLAVEHYLRDQQLLGIWGCSGKLICCT

NVPWNSSWSNRNLSEIWDNMTWLQWDKEISNYTQIIYGLLEESQNQQEKNEQDLLALD

-continued (d) BG505_SOSIP_D664_olio6_CD4KO4_mC
(SEQ ID NO: 76)
AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNVTNNIT

DDMRGELKNCSFNMTTELRDKKQKVYSLFWRLDVVQINENQGNRSNNSNKEYRLIN

CNTSAITQACPKVSFEPIPIHYCAPAGFAILKCKDKKFNGTGPCPSVSTVQCTHGIKPVV

STQLLLNGSLAEEEVIIRSENITNNAKNILVQLNTPVQINCTAPNNFTVKSIRIGPGQAFY

YMGDIIGDIRQAHCNVSKATWNETLGKVVKQLRKHFGNNTIIRFAQSSGGDLEVTTHS

FNCGGMFFYCNTSGLFNSTWISNTSVQGSNSTGSNDSITLPCRIKLIINMWQRIGQAMY

APPIQGVIRCVSNITGLILTRDGGSTNSTTETFRPGGTDMRDNWRSELYKYKVVKIEPL

GVAPTRCKRRVVGRRRRRRAVGIGAVSLGFLGAAGSTMGAASMTLTVQARNLLSGIV

QQQSNLLRAPEPQQHLLKDTHWGIKQLQARVLAVEHYLRDQQLLGIWGCSGKLICCT

NVPWNSSWSNRNLSEIWDNMTWLQWDKEISNYTQIIYGLLEESQNQQEKNEQDLLALD (e) AC10_SOSIP_olio6_congly_mC
(SEQ ID NO: 78)
AVEQTWVTVYYGVPVWKEANTTLFCASDAKAYNTEVHNVWATHACVPTDPNP

QEVELENVTENFNMWKNNMVDQMHEDIISLWDQSLKPCVKLTPLCVTLSCTDNVGN

DTSTNNSRWDKMEKGEIKNCSFNITTNMRDKMQKQYALFWKLDVVPIEEGKNNNSSF

TDYRLISCNTSVITQACPKVTFEPIPIHYCAPAGFALLKCKDKKFNGTGPCKNVSTVQC

THGIKPVVSTQLLLNGSLAEEEVVIRSENFSNNARTIIVQLNTSVEINCTAPNNFTVKGI

HIGPGRAFYYMGDIIGDIRQAHCNISRQNWNNTLKQIAEKLREQFGNKTIVFRQSSGGD

PEIVMHTFNCAGMFFYCNTSELFNSTWYANGTISIGGGNKTNIILPCRIKLFINMWQEV

GKAMYAPPISGQIRCSSNITGLLLTRDGGRGNQTDNQTEIFRPVGGDMKNNWRSELYK

YKVVRIEPLGIAPTRCKRRVVGRRRRRRAVGIGALSLGFLGAAGSTMGAASMTLTVQ

ARLLLSGIVQQQNNLLRAPEPQQHLLQDTHWGIKQLQARVLAVEHYLRDQQLLGIWG

CSGKLICCTAVPWNVSWNNRSVDDIWENMTWMQWDREISNYTSLIYTLIEESQNQQE

KNEQELLALD

9. The non-naturally occurring protein of numbered paragraph 1 or 2, wherein the trimer comprises any one of:

(a) 191084_SOSIP_MD39
(SEQ ID NO: 80)
TENLWVTVYYGVPVWRDAETTLFCASDAKAYDTEMHNVWATHACVPTDPNPQ

EIDLENVTEKFNMWKNNMVEQMHEDIISLWDQSLKPCVKLTPLCVTLNCTAITNDTR

GNETGINRTVETTEMTNCSFNMTTELRDRKKKVNALFYKLDIVQIGENSSSQYRLINC

NTSVITQACPKVTFEPIPIHYCAPAGFAILKCKDKEFNGTGTCRNVSSVQCTHGIKPVVS

TQLLLNGSLAEGQVIIRSENISDNAKTIIVQLNESVPINCTRPNNNTVRGIHLGPGQTFFY

TDIIGDIRQAHCNVSESKWNKALQEVVKQLRQHWNKTIIFKSSSGGDLEITTHSFNCGG

EFFYCNTSGLFNSTWNIAGNRTNDTKSNETITLPCRIKQIVNVWQRVGQAIYAPPIAGVI

RCNSNITGLLLVRDGGATNNTDETFRPGGGNMRDNWRSELYKYKVVKIEPLGVAPTR

CRRRVVERRRRRRAVGLGAVSIGFLGAAGSTMGAASVTLTVQARQLLSGIVQQQSNL

LRAPEPQQHLLKDTHWGIKQLQARVLAVEHYLKDQQLLGIWGCSGKLICCTTVPWNS

SWSNKSQNEIWDNMTWLQWDKEISNYTQLIYSLIEESQNQQEKNEQELLALD

-continued (b) 001428_SOSIP_MD39

(SEQ ID NO: 81)

VENLWVTVYYGVPVWKEARTTLFCASDAKAYETEVHNVWATHACVPTDPNPQ

EMVLGNVTENFNMWKNDMVDQMHEDVISLWAQSLKPCVKLTPLCVTLECTQVNAT

QGNTTQVNVTQVNGDEMKNCSFNTTTEIRDKKQKAYALFYRLDLVPLERENRGDSNS

ASKYILINCNTSAITQACPKVNFDPIPIHYCTPAGYAILKCNNKTFNGTGSCNNVSTVQC

THGIKPVVSTQLLLNGSLAEEEIIRSENLTDNVKTIIVHLDQSVEIVCTRPNNNTVKSIRI

GPGQTFYYTGDIIGNIREAHCNISEKKWHEMLRRVSEKLAEHFPNKTIKFTSSSGGDLEI

TTHSFNCRGEFFYCNTSGLFNSTYMPNGTYMPNGTNNSNSTIILPCRIKQIINMWQEVG

RAMYAPPIAGNITCNSNITGLLLVRDGGKNNNTEIFRPGGGDMRDNWRSELYKYKVV

EIKPLGVAPTRCKRRVVGRRRRRRAVGLGAVSLGFLGAAGSTMGAASITLTVQARQL

LSGIVQQQSNLLQAPEPQQHLLQDTHWGIKQLQTRVLAIEHYLKDQQLLGIWGCSGKL

ICCTAVPWNSSWSNKSLTDIWDNMTWMQWDREVSNYTGIIYRLLEDSQNQQERNEQ

DLLALD (c) AC10_SOSIP_MD39

(SEQ ID NO: 82)

AVEQTWVTVYYGVPVWKEANTTLFCASDAKAYNTEVHNVWATHACVPTDPNP

QEVELENVTENFNMWKNNMVDQMHEDIISLWDQSLKPCVKLTPLCVTLSCTDNVGN

DTSTNNSRWDKMEKGEIKNCSFNITTNMRDKMQKYALFYKLDVVPIEEGKNNNSSF

TDYRLISCNTSVITQACPKVTFEPIPIHYCAPAGFALLKCKDKKFNGTGPCKNVSTVQC

THGIKPVVSTQLLLNGSLAEEEVVIRSENFSNNARTIIVQLNTSVEIKCIRPNNNTVKGIH

IGPGRAFYYTGDIIGDIRQAHCNISRQNWNNTLKQIAEKLREQFGNKTIVFRQSSGGDP

EIVMHTFNCAGEFFYCNTAELFNSTWYANGTISIGGGNKTNIILPCRIKQFINMWQEVG

KAMYAPPISGQIRCSSNITGLLLTRDGGRGNQTDNQTEIFRPVGGDMKNNWRSELYKY

KVVRIEPLGIAPTRCKRRVVGRRRRRRAVGIGALSLGFLGAAGSTMGAASMTLTVQA

RLLLSGIVQQQNNLLRAPEPQQHLLQDTHWGIKQLQARVLAVEHYLRDQQLLGIWGC

SGKLICCTAVPWNVSWNNRSVDDIWENMTWMQWDREISNYTSLIYTLIEESQNQQEK

NEQELLALD (d) AC10_SOSIP_olio6

(SEQ ID NO: 83)

AVEQTWVTVYYGVPVWKEANTTLFCASDAKAYNTEVHNVWATHACVPTDPNP

QEVELENVTENFNMWKNNMVDQMHEDIISLWDQSLKPCVKLTPLCVTLSCTDNVGN

DTSTNNSRWDKMEKGEIKNCSFNITTNMRDKMQKYALFWKLDVVPIEEGKNNNSSF

TDYRLISCNTSVITQACPKVTFEPIPIHYCAPAGFALLKCKDKKFNGTGPCKNVSTVQC

THGIKPVVSTQLLLNGSLAEEEVVIRSENFSNNARTIIVQLNTSVEIKCIAPNNFTVKGIH

IGPGRAFYYMGDIIGDIRQAHCNISRQNWNNTLKQIAEKLREQFGNKTIVFRQSSGGDP

EIVMHTFNCAGMFFYCNTAELFNSTWYANGTISIGGGNKTNIILPCRIKLFINMWQEVG

KAMYAPPISGQIRCSSNITGLLLTRDGGRGNQTDNQTEIFRPVGGDMKNNWRSELYKY

KVVRIEPLGIAPTRCKRRVVGRRRRRRAVGIGALSLGFLGAAGSTMGAASMTLTVQA

RLLLSGIVQQQNNLLRAPEPQQHLLQDTHWGIKQLQARVLAVEHYLRDQQLLGIWGC

SGKLICCTAVPWNVSWNNRSVDDIWENMTWMQWDREISNYTSLIYTLIEESQNQQEK

NEQELLALD

-continued (e) ZM197M_MD39

(SEQ ID NO: 84)
MEQLWVTVYYGVPVWKEAKATLFCASDAKAYEKEVHNVWATHACVPTDPNP

QEIPLGNVTENFNMWKNDMADQMHEDIISLWDQSLKPCVKLTPLCVTLNCSDATSNT

TKNATNTNTTSTDNRNATSNDTEMKGEIKNCTFNITTEVRDRKTKQRALFYKLDVVPL

EEEKNSSSKNSSYKEYRLISCNTSTITQACPKVSFDPIPIHYCAPAGYAILKCNNKTFNG

TGPCHNVSTVQCTHGIKPVVSTQLLLNGSLAEEEIIIRSENLTDNTKTIIVHLNESVEINC

TRPNNNTVKSVRIGPGQTFFYTGEIIGDIRQAHCNLSKSNWTTTLKRIEKKLKEHFNNA

TIKFESSAGGDLETTTHSFNCRGEFFYCNTSGLFNSSLLNDTDGTSNSTSNATITLPCRIK

QIINMWQEVGRAMYASPIAGIITCKSNITGLLLTRDGGNKSAGIETFRPGGGNMKDNW

RSELYKYKVVEIKPLGIAPTSCKRRVVERRRRRRAAGIGAVSLGFLGAAGSTMGAASV

MLTVQARQLLSGIVQQQSNLLRAPEPQQHMLQDTHWGIKQLQTRVLAIEHYLKDQQL

LGLWGCSGKLICCTAVPWNTSWSNKSKDEIWDNMTWMQWDREIDNYTQVIYQLLEV

SQNQQEKNENDLLALD (f) B41_SOSIP_D664_MD39

(SEQ ID NO: 85)
AAKKWVTVYYGVPVWKEATTTLFCASDAKAYDTEVHNVWATHACVPTDPNPQ

EIVLGNVTENFNMWKNNMVEQMHEDIISLWDQSLKPCVKLTPLCVTLNCNNVNTNN

TNNSTNATISDWEKMETGEMKNCSFNVTTSIRDKIKKEYALFYKLDVVPLENKNNINN

TNITNYRLINCNTSVITQACPKVSFEPIPIHYCAPAGFAILKCNSKTFNGSGPCTNVSTVQ

CTHGIRPVVSTQLLLNGSLAEEEIVIRSENITDNAKTIIVQLNEAVEINCTRPNNNTVKSI

HIGPGRAFYYTGDIIGNIRQAHCNISKARWNETLGQIVAKLEEQFPNKTIIFNHSSGGDP

EIVTHSFNCGGEFFYCNTTPLFNSTWNNTRTDDYPTGGEQNITLQCRIKQIINMWQGVG

KAMYAPPIRGQIRCSSNITGLLLTRDGGRDQNGTETFRPGGGNMRDNWRSELYKYKV

VKIEPLGIAPTACKRRVVQRRRRRRAVGLGAFSLGFLGAAGSTMGAASMALTVQARL

LLSGIVQQQNNLLRAPEPQQHMLQDTHWGIKQLQARVLAVEHYLRDQQLLGIWGCS

GKIICCTNVPWNDSWSNKTINEIWDNMTWMQWEKEIDNYTQHIYTLLEVSQIQQEKN

EQELLELD

10. The non-naturally occurring protein of numbered paragraph 1 or 2, wherein the trimer comprises any one of:

(a) BG505_SOSIP_MD39_link14

(SEQ ID NO: 86)
AENLWVTVYYGVPVWKDAETTLFCASDAKAYETEKHNVWATHACVPTDPNPQ

EIHLENVTEEFNMWKNNMVEQMHEDIISLWDQSLKPCVKLTPLCVTLQCTNVTNNIT

DDMRGELKNCSFNMTTELRDKKQKVYSLFYRLDVVQINENQGNRSNNSNKEYRLINC

NTSAITQACPKVSFEPIPIHYCAPAGFAILKCKDKKFNGTGPCPSVSTVQCTHGIKPVVS

TQLLLNGSLAEEEVIIRSENITNNAKNILVQLNTPVQINCTRPNNNTVKSIRIGPGQAFY

YTGDIIGDIRQAHCNVSKATWNETLGKVVKQLRKHFGNNTIIRFAQSSGGDLEVTTHS

FNCGGEFFYCNTSGLFNSTWISNTSVQGSNSTGSNDSITLPCRIKQIINMWQRIGQAMY

APPIQGVIRCVSNITGLILTRDGGSTNSTTETFRPGGGDMRDNWRSELYKYKVVKIEPL

GVAPTRCKRRVVGSHSGSGGSGSGGHAAVGIGAVSLGFLGAAGSTMGAASMLTVQ

ARNLLSGIVQQQSNLLRAPEPQQHLLKDTHWGIKQLQARVLAVEHYLRDQQLLGIWG

CSGKLICCTNVPWNSSWSNRNLSEIWDNMTWLQWDKEISNYTQIIYGLLEESQNQQEK

NEQDLLALD (b) BG505_SOSIP_MD39_CP1.1

(SEQ ID NO: 87)

VSLGFLGAAGSTMGAASMTLTVQARNLLSGIVQQQSNLLRAPEPQQHLLKDTH

WGIKQLQARVLAVEHYLRDQQLLGIWGCSGKLICCTNVPWNSSWSNRNLSEIWDNM

TWLQWDKEISNYTQIIYGLLEESQNQQEKNEQDLLALDGGSGSGGGSGSGGSSAENL

WVTVYYGVPVWKDAETTLFCASDAKAYETEKHNVWATHACVPTDPNPQEIHLENVT

EEFNMWKNNMVEQMHEDIISLWDQSLKPCVKLTPLCVTLQCTNVTNNITDDMRGEL

KNCSFNMTTELRDKKQKVYSLFYRLDVVQINENQGNRSNNSNKEYRLINCNTSAITQA

CPKVSFEPIPIHYCAPAGFAILKCKDKKFNGTGPCPSVSTVQCTHGIKPVVSTQLLLNGS

LAEEEVIIRSENITNNAKNILVQLNTPVQINCTRPNNNTVKSIRIGPGQAFYYTGDIIGDI

RQAHCNVSKATWNETLGKVVKQLRKHFGNNTIIRFAQSSGGDLEVTTHSFNCGGEFF

YCNTSGLFNSTWISNTSVQGSNSTGSNDSITLPCRIKQIINMWQRIGQAMYAPPIQGVIR

CVSNITGLILTRDGGSTNSTTETFRPGGGDMRDNWRSELYKYKVVKIEPLGVAPTRCK

RRVVG (c) BG505_SOSIP_MD39_CP1.2

(SEQ ID NO: 88)

VSLGFLGAAGSTMGAASMTLTVQARNLLSGIVQQQSNLLRAPEPQQHLLKDTH

WGIKQLQARVLAVEHYLRDQQLLGIWGCSGKLICCTNVPWNSSWSNRNLSEIWDNM

TWLQWDKEISNYTQIIYGLLEESQNQQEKNEQDLGGSGSGGGSGSGGSSGSGLWVT

VYYGVPVWKDAETTLFCASDAKAYETEKHNVWATHACVPTDPNPQEIHLENVTEEF

NMWKNNMVEQMHEDIISLWDQSLKPCVKLTPLCVTLQCTNVTNNITDDMRGELKNC

SFNMTTELRDKKQKVYSLFYRLDVVQINENQGNRSNNSNKEYRLINCNTSAITQACPK

VSFEPIPIHYCAPAGFAILKCKDKKFNGTGPCPSVSTVQCTHGIKPVVSTQLLLNGSLAE

EEVIIRSENITNNAKNILVQLNTPVQINCTRPNNNTVKSIRIGPGQAFYYTGDIIGDIRQA

HCNVSKATWNETLGKVVKQLRKHFGNNTIIRFAQSSGGDLEVTTHSFNCGGEFFYCNT

SGLFNSTWISNTSVQGSNSTGSNDSITLPCRIKQIINMWQRIGQAMYAPPIQGVIRCVSNI

TGLILTRDGGSTNSTTETFRPGGGDMRDNWRSELYKYKVVKIEPLGVAPTRCKRR (d) BG505_SOSIP_MD39_CP2

(SEQ ID NO: 89)

VSLGFLGAAGSTMGAASMTLTVQARNLLSGIVQQQSNLLRAPEPQQHLLKDTH

WGIKQLQARVLAVEHYLRDQQLLGIWGCSGKLICCTGGSGVTVYYGVPVWKDAETT

LFCASDAKAYETEKHNVWATHACVPTDPNPQEIHLENVTEEFNMWKNNMVEQMHE

DIISLWDQSLKPCVKLTPLCVTLQCTNVTNNITDDMRGELKNCSFNMTTELRDKKQKV

YSLFYRLDVVQINENQGNRSNNSNKEYRLINCNTSAITQACPKVSFEPIPIHYCAPAGFA

ILKCKDKKFNGTGPCPSVSTVQCTHGIKPVVSTQLLLNGSLAEEEVIIRSENITNNAKNI

LVQLNTPVQINCTRPNNNTVKSIRIGPGQAFYYTGDIIGDIRQAHCNVSKATWNETLGK

VVKQLRKHFGNNTIIRFAQSSGGDLEVTTHSFNCGGEFFYCNTSGLFNSTWISNTSVQG

SNSTGSNDSITLPCRIKQIINMWQRIGQAMYAPPIQGVIRCVSNITGLILTRDGGSTNSTT

ETFRPGGGDMRDNWRSELYKYKVVKIEPLGVAPTRCKRGGSGSGVPWNSSWSNRNL

SEIWDNMTWLQWDKEISNYTQIIYGLLEESQNQQEKNEQDLLALD (e) BG505_SOSIP_MD39_CP3
(SEQ ID NO: 90)
VSLGFLGAAGSTMGAASMTLTVQARNLLSGIVQQQSNLLRAPEPQQHLLKDTH
WGIKQLQARVLAVEHYLRDQQLLGIWGCSGKLICCTNVPWNSSWSNRNLSEIWDNM
TWLQWDKEISNYTQIIYGLLEESGGSGSGAGGLWVTVYYGVPVWKDAETTLFCASD
AKAYETEKHNVWATHACVPTDPNPQEIHLENVTEEFNMWKNNMVEQMHEDIISLWD
QSLKPCVKLTPLCVTLQCTNVTNNITDDMRGELKNCSFNMTTELRDKKQKVYSLFYR
LDVVQINENQGNRSNNSNKEYRLINCNTSAITQACPKVSFEPIPIHYCAPAGFAILKCKD
KKFNGTGPCPSVSTVQCTHGIKPVVSTQLLLNGSLAEEEVIRSENITNNAKNILVQLNT
PVQINCTRPNNNTVKSIRIGPGQAFYYTGDIIGDIRQAHCNVSKATWNETLGKVVKQL
RKHFGNNTIIRFAQSSGGDLEVTTHSFNCGGEFFYCNTSGLFNSTWISNTSVQGSNSTG
SNDSITLPCRIKQIINMWQRIGQAMYAPPIQGVIRCVSNITGLILTRDGGSTNSTTETFRP
GGGDMRDNWRSELYKYKVVKIEPLGVAPTRCKRRVVGGSGSGQNQQEKNEQDLL
ALD

11. The non-naturally occurring protein of numbered paragraph 1 or 2, wherein the trimer comprises any one of:

(a) BG505_MD39_GRSF4
(SEQ ID NO: 91)
AENLWVTVYYGVPVWKDAETTLFCASDAKAYETEKHNVWATHACVPTDPNSS
EIHLENVTEEFNMWKNNMVEQMHEDIISLWDQSLKPCVKLTPLCVTLQCTNVTNNITDD
MRGELKNCSFNMTTELRDKKQKVYSLFYRLDVVQINENQGNRSNNSNKEYRLINCNTS
AITQACPKVSFEPIPIHYCAPAGFAILKCKDKKFNGTGPCQNVSTVQCTHGIKPVVSTQLL
LNGSLAEEEVIIRSENITNNAKNILVQLNTSVQINCTRPNNNTVKSIRIGPGQAFYYTGDII
GDIRQAHCNVSKATWNETLGKVVKQLRKHFGNNTIIRFAQSSGGDLEVTTHSFNCGGEF
FYCNTSGLFNSTWISNTSVQGSNSTGSNDSITLPCRIKQIINMWQRIGQAMYAPPIQGVIR
CVSNITGLILTRDGGSTNSTTETFRPGGGDMRDNWRSELYKYKVVKIEPLGVAPTRCKR
RVVGRRRRRRAVGIGAVSLGFLGAAGSTMGAASMTLTVQARNLLSGIVQQQSNLLRAP
EPQQHLLKDTHWGIKQLQARVLAVEHYLRDQQLLGIWGCSGKLICCTNVPWNSSWSNR
NLSEIWDNMTWLQWDKEISNYTQIIYGLLEESQNQQEKNNQSLLALDNGS

(b) BG505_MD39_GRSF7
(SEQ ID NO: 92)
AENLWVTVYYGVPVWKDAETTLFCASDAKAYETEKHNVWATHACVPTDPNSS
EIHLENVTEEFNMWKNNMVEQMHEDIISLWDQSLKPCVKLTPLCVTLQCTNVTNNITDD
MRGELKNCSFNMTTELRDKKQKVYSLFYRLDVVQINENQGNRSNNSNKEYRLINCNTS
AITQACPKVSFEPIPIHYCAPAGFAILKCKDKKFNGTGPCQNVSTVQCTHGIKPVVSTQLL
LNGSLAEEEVIIRSENITNNAKNILVQLNTSVQINCTRPNNNTVKSIRIGPGQAFYYTGDII
GDIRQAHCNVSKATWNETLGKVVKQLRKHFGNNTIIRFAQSSGGDLEVTTHSFNCGGEF
FYCNTSGLFNSTWISNTSVQGSNSTGSNDSITLPCRIKQIINMWQRIGQAMYAPPIQGVIR
CVSNITGLILTRDGGSTNSTTETFRPGGGDMRDNWRSELYKYKVVKIEPLGVAPTRCKR
RVVGRRRRRRAVGIGAVSLGFLGAAGSTMGAASMTLTVQARNLLSGIVQQQSNLLRAP
EPQQHLLKDTHWGIKQLQARVLAVEHYLRDQQLLGIWGCSGKLICCTNVPWNSSWSNA
NLSEIWDNMTWLQWDKNISNYTQIIYGLLEESQNQQEKNNQSLLALDNGS

(c) BG505_MD39_CP1.2_GRSF4

(SEQ ID NO: 93)

VSLGFLGAAGSTMGAASMTLTVQARNLLSGIVQQQSNLLRAPEPQQHLLKDTH

WGIKQLQARVLAVEHYLRDQQLLGIWGCSGKLICCTNVPWNSSWSNRNLSEIWDNMT

WLQWDKEISNYTQIIYGLLEESQNQQEKNEQDLGGNGSGGGSGGNGSGLWVTVY

YGVPVWKDAETTLFCASDAKAYETEKHNVWATHACVPTDPNSSEIHLENVTEEFNMW

KNNMVEQMHEDIISLWDQSLKPCVKLTPLCVTLQCTNVTNNITDDMRGELKNCSFNMT

TELRDKKQKVYSLFYRLDVVQINENQGNRSNNSNKEYRLINCNTSAITQACPKVSFEPIPI

HYCAPAGFAILKCKDKKFNGTGPCQNVSTVQCTHGIKPVVSTQLLLNGSLAEEEVIIRSE

NITNNAKNILVQLNTSVQINCTRPNNNTVKSIRIGPGQAFYYTGDIIGDIRQAHCNVSKAT

WNETLGKVVKQLRKHFGNNTIIRFAQSSGGDLEVTTHSFNCGGEFFYCNTSGLFNSTWIS

NTSVQGSNSTGSNDSITLPCRIKQIINMWQRIGQAMYAPPIQGVIRCVSNITGLILTRDGGS

TNSTTETFRPGGGDMRDNWRSELYKYKVVKIEPLGVAPTRCKRR (d) BG505_MD39_link14_GRSF4

(SEQ ID NO: 94)

AENLWVTVYYGVPVWKDAETTLFCASDAKAYETEKHNVWATHACVPTDPNSS

EIHLENVTEEFNMWKNNMVEQMHEDIISLWDQSLKPCVKLTPLCVTLQCTNVTNNITDD

MRGELKNCSFNMTTELRDKKQKVYSLFYRLDVVQINENQGNRSNNSNKEYRLINCNTS

AITQACPKVSFEPIPIHYCAPAGFAILKCKDKKFNGTGPCQNVSTVQCTHGIKPVVSTQLL

LNGSLAEEEVIIRSENITNNAKNILVQLNTSVQINCTRPNNNTVKSIRIGPGQAFYYTGDII

GDIRQAHCNVSKATWNETLGKVVKQLRKHFGNNTIIRFAQSSGGDLEVTTHSFNCGGEF

FYCNTSGLFNSTWISNTSVQGSNSTGSNDSITLPCRIKQIINMWQRIGQAMYAPPIQGVIR

CVSNITGLILTRDGGSTNSTTETFRPGGGDMRDNWRSELYKYKVVKIEPLGVAPTRCKR

RVVGSHSGSGGSGSGGHAAVGIGAVSLGFLGAAGSTMGAASMTLTVQARNLLSGIVQ

QQSNLLRAPEPQQHLLKDTHWGIKQLQARVLAVEHYLRDQQLLGIWGCSGKLICCTNV

PWNSSWSNRNLSEIWDNMTWLQWDKEISNYTQIIYGLLEESQNQQEKNNQSLLALDNGS

(e) BG505_MD39_link14_GRSF7

(SEQ ID NO: 95)

AENLWVTVYYGVPVWKDAETTLFCASDAKAYETEKHNVWATHACVPTDPNSS

EIHLENVTEEFNMWKNNMVEQMHEDIISLWDQSLKPCVKLTPLCVTLQCTNVTNNITDD

MRGELKNCSFNMTTELRDKKQKVYSLFYRLDVVQINENQGNRSNNSNKEYRLINCNTS

AITQACPKVSFEPIPIHYCAPAGFAILKCKDKKFNGTGPCQNVSTVQCTHGIKPVVSTQLL

LNGSLAEEEVIIRSENITNNAKNILVQLNTSVQINCTRPNNNTVKSIRIGPGQAFYYTGDII

GDIRQAHCNVSKATWNETLGKVVKQLRKHFGNNTIIRFAQSSGGDLEVTTHSFNCGGEF

FYCNTSGLFNSTWISNTSVQGSNSTGSNDSITLPCRIKQIINMWQRIGQAMYAPPIQGVIR

CVSNITGLILTRDGGSTNSTTETFRPGGGDMRDNWRSELYKYKVVKIEPLGVAPTRCKR

RVVGSHSGSGGSGSGGHAAVGIGAVSLGFLGAAGSTMGAASMTLTVQARNLLSGIVQ

QQSNLLRAPEPQQHLLKDTHWGIKQLQARVLAVEHYLRDQQLLGIWGCSGKLICCTNV

PWNSSWSNANLSEIWDNMTWLQWDKNISNYTQIIYGLLEESQNQQEKNNQSLLALDNGS

12. The non-naturally occurring protein of numbered paragraph 1 or 2, wherein the trimer comprises any one of:

(a) BG505_MD39_CP1.2_GRSF4_qLoops1
(SEQ ID NO: 96)
VSLGFLGAAGSTMGAASMTLTVQARNLLSGIVQQQSNLLRAPEPQQHLLK
DTHWGIKQLQARVLAVEHYLRDQQLLGIWGCSGKLICCTNVPWNSSWSNR
NLSEIWDNMTWLQWDKEISNYTQIIYGLLEESQNQQEKNEQDL**GGNGSGG
GSGSGGNGSSG**LWVTVYYGVPVWKDAETTLFCASDAKAYETEKHNVWATH
ACVPTDPNSSEIHLENVTEEFNMWKNNMVEQMHEDIISLWDQSLKPCVKL
TPLCVTLQCTNVTNNITDNMTGELKNCSFNMTTELRDKKQKVYSLFYRLD
VVQINGSGGEYRLINCNTSAITQACPKVSFEPIPIHYCAPAGFAILKCKD
KKFNGTGPCQNVSTVQCTHGIKPVVSTQLLLNGSLAEEEVIIRSENITNN
AKNILVQLNTSVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWPENGTMEGSNGTITLPCRIKQIINMWQRIGQAMYAP
PIQGVIRCVSNITGLILTRDGGSTNSTTETFRPGGGDMRDNWRSELYKYK
VVKIEPLGVAPTRCKRR (b) BG505_MD39_CP1.2_GRSF7_qLoops1
(SEQ ID NO: 97)
GGNSSGSLGFLGAAGSTMGAASMTLTVQARNLLSGIVQQQSNLLRAPEPQ
QHLLKDTHWGIKQLQARVLAVEHYLRDQQLLGIWGCSGKLICCTNVPWNS
SWSNRNLSEIWDNMTWLQWDKEISNYTQIIYGLLEESQNQNESNEQDL**GG
NGSGGGSGSGGNGSSG**LWVTVYYGVPVWKDAETTLFCASDAKAYETEKHN
VWATHACVPTDPNSSEIHLENVTEEFNMWKNNMVEQMHEDIISLWDQSLK
PCVKLTPLCVTLQCTNVTNNITDNMTGELKNCSFNMTTELRDKKQKVYSL
FYRLDVVQINGSGGEYRLINCNTSAITQACPKVSFEPIPIHYCAPAGFAI
LKCKDKKFNGTGPCQNVSTVQCTHGIKPVVSTQLLLNGSLAEEEVIIRSE
NITNNAKNILVQLNTSVQINCTRPNNNTVKSIRIGPGQAFYYTGDIIGDI
RQAHCNVSKATWNETLGKVVKQLRKHFGNNTIIRFAQSSGGDLEVTTHSF
NCGGEFFYCNTSGLFNSTWPENGTMEGSNGTITLPCRIKQIINMWQRIGQ
AMYAPPIQGVIRCVSNITGLILTRDGGSTNSTTETFRPGGGDMRDNWRSE
LYKYKVVKIEPLGVAPTRCNRS

(c) BG505_MD39_GRSF4_qLoops1
(SEQ ID NO: 98)
AENLWVTVYYGVPVWKDAETTLFCASDAKAYETEKHNVWATHACVPTDPN
SSEIHLENVTEEFNMWKNNMVEQMHEDIISLWDQSLKPCVKLTPLCVTLQ
CTNVTNNITDNMTGELKNCSFNMTTELRDKKQKVYSLFYRLDVVQI**NGSG
G**EYRLINCNTSAITQACPKVSFEPIPIHYCAPAGFAILKCKDKKFNGTGP
CQNVSTVQCTHGIKPVVSTQLLLNGSLAEEEVIIRSENITNNAKNILVQL
NTSVQINCTRPNNNTVKSIRIGPGQAFYYTGDIIGDIRQAHCNVSKATWN
ETLGKVVKQLRKHFGNNTIIRFAQSSGGDLEVTTHSFNCGGEFFYCNTSG
LFNSTWPENGTMEGSNGTITLPCRIKQIINMWQRIGQAMYAPPIQGVIRC
VSNITGLILTRDGGSTNSTTETFRPGGGDMRDNWRSELYKYKVVKIEPLG
VAPTRCKRRVGRRRRRRAVGIGAVSLGFLGAAGSTMGAASMTLTVQARN LLSGIVQQQSNLLRAPEPQQHLLKDTHWGIKQLQARVLAVEHYLRDQQLL
GIWGCSGKLICCTNVPWNSSWSNRNLSEIWDNMTWLQWDKEISNYTQIIY
GLLEESQNQQEKNNQSLLALDNGS

13. The non-naturally occurring protein of numbered paragraph 1 or 2, wherein the trimer comprises any one of:

(a) BG505_SOSIP_MD39_2JD6
(SEQ ID NO: 99)
AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVIIRSENITNN
AKNILVQLNTPVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVGRRRRRRAVGIGAVSLGFLGAAGSTM
GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALDGSGGLSERMLKALNDQ
LNRELYSAYLYFAMAAYFEDLGLEGFANWMKAQAEEEIGHALRFYNYIYD
KNGRVELDEIPKPPKEWESPLKAFEAAYEHEKFISKSIYELAALAEEEKD
YSTRAFLEWFINEQVEEEASVKKILDKLKFAKDSPQILFMLDKELSARAP
KLPGLLMQGGE**

(b) BG505 SOSIP MD39 E2p (also referred to as "MD39-1b5s")
(SEQ ID NO: 100)
AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVIIRSENITNN
AKNILVQLNTPVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVGRRRRRRAVGIGAVSLGFLGAAGSTM
GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALDASGAAAKPATTEGEFP
ETREKMSGIRRAIAKAMVHSKHTAPHVTLMDEADVTKLVAHRKKFKAIAA
EKGIKLTFLPYVVKALVSALREYPVLNT[C/A/T]IDDETEEIIQK -continued
HYYNIGIAADTDRGLLVPVIKHADRKPIFALAQEINELAEKARDGKLTPG
EMKGASCTITNIGSAGGQWFTPVINHPEVAILGIGRIAEKPIVRDGEIVA
APMLALSLSFDHRMIDGATAQKALNHIKRLLSDPELLLM**

14. The non-naturally occurring protein of numbered paragraph 1 or 2, wherein the trimer comprises any one of:

(a) BG505_MD39_gp160_dCT
(SEQ ID NO: 101)
AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVIIRSENITNN
AKNILVQLNTPVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVSLGFLGAAGSTM
GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALDKWASLWNWFDISNWLW
YIKIFIMIVGGLIGLRIVFAVLSVIHRVRQGYSPLS**

(b) BG505_MD39_gp160_dCT_GRSF4.1
(SEQ ID NO: 102)
AENLWVTVYYGVPVWKDAETTLFCASDAKAYETEKHNVWATHACVPTDPN
SSEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCQNVSTVQCTHGIKPVVSTQLLLNGSLAEEEVIIRSENITNN
AKNILVQLNTSVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVSLGFLGAAGSTM
GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALDKWASLWNWFDISNWLW
YIKIFIMIVGGLIGLRIVFAVLSVIHRVRQGYSPLS**

(c) BG505_MD39_gp160_GRSF4.1_m
(SEQ ID NO: 103)
AENLWVTVYYGVPVWKDAETTLFCASDAKAYETEKHNVWATHACVPTDPN
SSEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCQNVSTVQCTHGIKPVVSTQLLLNGSLAEEEVIIRSENITNN
AKNILVQLNTSVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVSLGFLGAAGSTM
GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALDKWASLWNWFDISNWLW
YIKIFIMIVGGLIGLRIVFAVLSVIHRVRQGYSPLSFQTHTPNPRGLDRP
ERIEEEDGEQDRGRSTRLVSGFLALAWDDLRSLCLFCYHRLRDFILIAAR
IVELLGHSSLKGLRLGWEGLKYLWNLLAYWGRELKISAINLFDTIAIAVA
EWTDRVIEIGQRLCRAFLHIPRRIRQGLERALL**

(d) BG505_MD39_gp140-PDGFR
(SEQ ID NO: 104)
AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVIIRSENITNN
AKNILVQLNTPVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVSLGFLGAAGSTM
GAASMTLTVQARNLLSGIVQQQSNLLRAPEPQQHLLKDTHWGIKQLQARV
LAVEHYLRDQQLLGIWGCSGKLICCTNVPWNSSWSNRNLSEIWDNMTWLQ
WDKEISNYTQIIYGLLEESQNQQEKNEQDLLALDGGSGGSGGSEQKLIS
EEDLGGSGGSGGSNAVGQDTQEVIVVPHSLPFKVVVISAILALVVLTIIS
LIILIMLWQKKPR**

(e) BG505_MD39_gp140-PDGFR_GRSF4.1_m
(SEQ ID NO: 105)
AENLWVTVYYGVPVWKDAETTLFCASDAKAYETEKHNVWATHACVPTDPN
SSEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCQNVSTVQCTHGIKPVVSTQLLLNGSLAEEEVIIRSENITNN
AKNILVQLNTSVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGRRRRRRAVGIGAVSLGFLGAAGSTM
GAASMTLTVQARNLLSGIVQQQSNLLRAPEPQQHLLKDTHWGIKQLQARV

-continued

LAVEHYLRDQQLLGIWGCSGKLICCTNVPWNSSWSNRNLSEIWDNMTWLQ
WDKEISNYTQIIYGLLEESQNQQEKNEQDLLALDGGGSGGSGGGSEQKLIS
EEDLGGSGGSGGSNAVGQDTQEVIVVPHSLPFKVVVISAILALVVLTIIS
LIILIMLWQKKPR**

(f) BG505_MD39_gp140-PDGFR_link14
(SEQ ID NO: 106)
AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVIIRSENITNN
AKNILVQLNTPVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGSHSGSGGSGSGGHAAVGIGAVSLGF
LGAAGSTMGAASMTLTVQARNLLSGIVQQQSNLLRAPEPQQHLLKDTHWG
IKQLQARVLAVEHYLRDQQLLGIWGCSGKLICCTNVPWNSSWSNRNLSEI
WDNMTWLQWDKEISNYTQIIYGLLEESQNQQEKNEQDLLALDGGGSGGSG
GSEQKLISEEDLGGSGGSGGSNAVGQDTQEVIVVPHSLPFKVVVISAILA
LVVLTIISLIILIMLWQKKPR**

(g) BG505_MD39_gp160-dCT_link14
(SEQ ID NO: 107)
AENLWVTVYYGVPVWKDAETTLFCASDAKAYETEKHNVWATHACVPTDPN
PQEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCPSVSTVQCTHGIKPVVSTQLLLNGSLAEEEVIIRSENITNN
AKNILVQLNTPVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGSHSGSGGSGSGGHAAVGIGAVSLGF
LGAAGSTMGAASMTLTVQARNLLSGIVQQQSNLLRAPEPQQHLLKDTHWG
IKQLQARVLAVEHYLRDQQLLGIWGCSGKLICCTNVPWNSSWSNRNLSEI
WDNMTWLQWDKEISNYTQIIYGLLEESQNQQEKNEQDLLALDKWASLWNW
FDISNWLWYIKIFIMIVGGLIGLRIVFAVLSVIHRVRQGYSPLS**

(h) BG505_MD39_gp160-dCT_link14_GRSF4.1
(SEQ ID NO: 108)
AENLWVTVYYGVPVWKDAETTLFCASDAKAYETEKHNVWATHACVPTDPN
SSEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCQNVSTVQCTHGIKPVVSTQLLLNGSLAEEEVIIRSENITNN
AKNILVQLNTSVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGSHSGSGGSGSGGHAAVGIGAVSLGF
LGAAGSTMGAASMTLTVQARNLLSGIVQQQSNLLRAPEPQQHLLKDTHWG
IKQLQARVLAVEHYLRDQQLLGIWGCSGKLICCTNVPWNSSWSNRNLSEI
WDNMTWLQWDKEISNYTQIIYGLLEESQNQQEKNEQDLLALDKWASLWNW
FDISNWLWYIKIFIMIVGGLIGLRIVFAVLSVIHRVRQGYSPLS**

(i) BG505_MD39_gp140-PDGFR_link14_GRSF4.1
(SEQ ID NO: 109)
AENLWVTVYYGVPVWKDAETTLFCASDAKAYETEKHNVWATHACVPTDPN
SSEIHLENVTEEFNMWKNNMVEQMHEDIISLWDQSLKPCVKLTPLCVTLQ
CTNVTNNITDDMRGELKNCSFNMTTELRDKKQKVYSLFYRLDVVQINENQ
GNRSNNSNKEYRLINCNTSAITQACPKVSFEPIPIHYCAPAGFAILKCKD
KKFNGTGPCQNVSTVQCTHGIKPVVSTQLLLNGSLAEEEVIIRSENITNN
AKNILVQLNTSVQINCTRPNNNTVKSIRIGPGQAFYYTGDIIGDIRQAHC
NVSKATWNETLGKVVKQLRKHFGNNTIIRFAQSSGGDLEVTTHSFNCGGE
FFYCNTSGLFNSTWISNTSVQGSNSTGSNDSITLPCRIKQIINMWQRIGQ
AMYAPPIQGVIRCVSNITGLILTRDGGSTNSTTETFRPGGGDMRDNWRSE
LYKYKVVKIEPLGVAPTRCKRRVVGSHSGSGGSGSGGHAAVGIGAVSLGF
LGAAGSTMGAASMTLTVQARNLLSGIVQQQSNLLRAPEPQQHLLKDTHWG
IKQLQARVLAVEHYLRDQQLLGIWGCSGKLICCTNVPWNSSWSNRNLSEI
WDNMTWLQWDKEISNYTQIIYGLLEESQNQQEKNEQDLLALDGGGSGGSG
GSEQKLISEEDLGGSGGSGGSNAVGQDTQEVIVVPHSLPFKVVVISAILA
LVVLTIISLIILIMLWQKKPR**

(j) BG505_MD39_gp140-PDGFR_CP1.2_GRSF4.0
(SEQ ID NO: 110)
VSLGFLGAAGSTMGAASMTLTVQARNLLSGIVQQQSNLLRAPEPQQHLLK
DTHWGIKQLQARVLAVEHYLRDQQLLGIWGCSGKLICCTNVPWNSSWSNR
NLSEIWDNMTWLQWDKEISNYTQIIYGLLEESQNQQEKNEQDL**GGNGSGG
GSGSGGNGSSG**LWVTVYYGVPVWKDAETTLFCASDAKAYETEKHNVWATH
ACVPTDPNSSEIHLENVTEEFNMWKNNMVEQMHEDIISLWDQSLKPCVKL
TPLCVTLQCTNVTNNITDDMRGELKNCSFNMTTELRDKKQKVYSLFYRLD
VVQINENQGNRSNNSNKEYRLINCNTSAITQACPKVSFEPIPIHYCAPAG
FAILKCKDKKFNGTGPCQNVSTVQCTHGIKPVVSTQLLLNGSLAEEEVII
RSENITNNAKNILVQLNTSVQINCTRPNNNTVKSIRIGPGQAFYYTGDII
GDIRQAHCNVSKATWNETLGKVVKQLRKHFGNNTIIRFAQSSGGDLEVTT
HSFNCGGEFFYCNTSGLFNSTWISNTSVQGSNSTGSNDSITLPCRIKQII
NMWQRIGQAMYAPPIQGVIRCVSNITGLILTRDGGSTNSTTETFRPGGGD

-continued

MRDNWRSELYKYKVVKIEPLGVAPTRCKRRGGGSGGSGGSEQKLISEEDL

GGSGGSGGSNAVGQDTQEVIVVPHSLPFKVVVISAILALVVLTIISLIIL

IMLWQKKPR**

(k) BG505_MD39_gp160-dCT_CP2_GRSF4.1

(SEQ ID NO: 111)
VSLGFLGAAGSTMGAASMTLTVQARNLLSGIVQQQSNLLRAPEPQQHLLK

DTHWGIKQLQARVLAVEHYLRDQQLLGIWGCSGKLICCTGGSGVTVYYGV

PVWKDAETTLFCASDAKAYETEKHNVWATHACVPTDPNSSEIHLENVTEE

FNMWKNNMVEQMHEDIISLWDQSLKPCVKLTPLCVTLQCTNVTNNITDDM

RGELKNCSFNMTTELRDKKQKVYSLFYRLDVVQINENQGNRSNNSNKEYR

LINCNTSAITQACPKVSFEPIPIHYCAPAGFAILKCKDKKFNGTGPCQNV

STVQCTHGIKPVVSTQLLLNGSLAEEEVIIRSENITNNAKNILVQLNTSV

QINCTRPNNNTVKSIRIGPGQAFYYTGDIIGDIRQAHCNVSKATWNETLG

KVVKQLRKHFGNNTIIRFAQSSGGDLEVTTHSFNCGGEFFYCNTSGLFNS

TWISNTSVQGSNSTGSNDSITLPCRIKQIINMWQRIGQAMYAPPIQGVIR

CVSNITGLILTRDGGSTNSTTETFRPGGGDMRDNWRSELYKYKVVKIEPL

GVAPTRCKRGGSGSGVPWNSSWSNRNLSEIWDNMTWLQWDKEISNYTQII

YGLLEESQNQQEKNEQDLLALDKWASLWNWFDISNWLWYIKIFIMIVGGL

IGLRIVFAVLSVIHRVRQGYSPLS**

(l) BG505_MD39_gp140-PDGFR_CP2_GRSF4.2

(SEQ ID NO: 112)
VSLGFLGAAGSTMGAASMTLTVQARNLLSGIVQQQSNLLRAPEPQQHLLK

DTHWGIKQLQARVLAVEHYLRDQQLLGIWGCSGKLICCTGGSGVTVYYGV

PVWKDAETTLFCASDAKAYETEKHNVWATHACVPTDPNSSEIHLENVTEE

FNMWKNNMVEQMHEDIISLWDQSLKPCVKLTPLCVTLQCTNVTNNITDDM

RGELKNCSFNMTTELRDKKQKVYSLFYRLDVVQINENQGNRSNNSNKEYR

LINCNTSAITQACPKVSFEPIPIHYCAPAGFAILKCKDKKFNGTGPCQNV

STVQCTHGIKPVVSTQLLLNGSLAEEEVIIRSENITNNAKNILVQLNTSV

QINCTRPNNNTVKSIRIGPGQAFYYTGDIIGDIRQAHCNVSKATWNETLG

KVVKQLRKHFGNNTIIRFAQSSGGDLEVTTHSFNCGGEFFYCNTSGLFNS

TWISNTSVQGSNSTGSNDSITLPCRIKQIINMWQRIGQAMYAPPIQGVIR

CVSNITGLILTRDGGSTNSTTETFRPGGGDMRDNWRSELYKYKVVKIEPL

GVAPTRCKRGGSGSGVPWNSSWSNRNLSEIWDNMTWLQWDKEISNYTQII

YGLLEESQNQQEKNNQSLLALDNGSGGGSGGSGGSEQKLISEEDLGGSGG

SGGSNAVGQDTQEVIVVPHSLPFKVVVISAILALVVLTIISLIILIMLWQ

KKPR**

(m) BG505_MD39_gp160_CP2_GRSF4.1

(SEQ ID NO: 113)
VSLGFLGAAGSTMGAASMTLTVQARNLLSGIVQQQSNLLRAPEPQQHLLK

DTHWGIKQLQARVLAVEHYLRDQQLLGIWGCSGKLICCTGGSGVTVYYGV

PVWKDAETTLFCASDAKAYETEKHNVWATHACVPTDPNSSEIHLENVTEE

FNMWKNNMVEQMHEDIISLWDQSLKPCVKLTPLCVTLQCTNVTNNITDDM

RGELKNCSFNMTTELRDKKQKVYSLFYRLDVVQINENQGNRSNNSNKEYR

LINCNTSAITQACPKVSFEPIPIHYCAPAGFAILKCKDKKFNGTGPCQNV

STVQCTHGIKPVVSTQLLLNGSLAEEEVIIRSENITNNAKNILVQLNTSV

QINCTRPNNNTVKSIRIGPGQAFYYTGDIIGDIRQAHCNVSKATWNETLG

KVVKQLRKHFGNNTIIRFAQSSGGDLEVTTHSFNCGGEFFYCNTSGLFNS

TWISNTSVQGSNSTGSNDSITLPCRIKQIINMWQRIGQAMYAPPIQGVIR

CVSNITGLILTRDGGSTNSTTETFRPGGGDMRDNWRSELYKYKVVKIEPL

GVAPTRCKRGGSGSGVPWNSSWSNRNLSEIWDNMTWLQWDKEISNYTQII

YGLLEESQNQQEKNEQDLLALDKWASLWNWFDISNWLWYIKIFIMIVGGL

IGLRIVFAVLSVIHRVRQGYSPLSFQTHTPNPRGLDRPERIEEEDGEQDR

GRSTRLVSGFLALAWDDLRSLCLFCYHRLRDFILIAARIVELLGHSSLKG

LRLGWEGLKYLWNLLAYWGRELKISAINLFDTIAIAVAEWTDRVIEIGQR

LCRAFLHIPRRIRQGLERALL**

15. The non-naturally occurring protein of numbered paragraph 1 comprising a gp120 with a PGT121-class germline-targeting mutation, wherein the protein comprises any one of a protein comprising the sequence of any one of FIG. 9-11 or 14.

16. A protein having at least 90% homology or identity with the sequence of the protein of any one of numbered paragraphs 2 to 15.

17. A protein having at least 95% homology or identity with the sequence of the protein of any one of numbered paragraphs 2 to 16.

18. A monomeric protein of any one of numbered paragraphs 2 to 15.

19. The protein of any one of numbered paragraphs 2-18 further comprising a tag for purification or biotinylation.

20. The protein of numbered paragraph 19 wherein the tag for purification is a his tag.

21. The protein of numbered paragraph 19 wherein the tag for biotinylation is an avi-tag.

22. The protein of any one of numbered paragraphs 2-21 further comprising an additional cysteine.

23. The protein of any one of numbered paragraphs any one of numbered paragraphs 2-22 fused to a multimerization motif.

24. A nucleic acid encoding the protein of any one of numbered paragraphs 2 to 23.

25. A nucleic acid having at least 90% homology or identity with the sequence of the nucleic acid of numbered paragraph 24.

26. A nucleic acid having at least 95% homology or identity with the sequence of the nucleic acid of numbered paragraph 24.

27. The nucleic acid of any one of numbered paragraphs 23-26 wherein the nucleic acid is a mRNA.

28. A method for eliciting an immune response comprising systemically administering to an animal in need thereof an effective amount of the protein of any one of numbered paragraphs 2-23.

29. The method of numbered paragraph 28, wherein the animal is a mammal.

30. The method of numbered paragraph 29, wherein the mammal is a human.

SUPPLEMENTAL REFERENCES

Adams, P. D., Afonine, P. V., Bunkoczi, G., Chen, V. B., Davis, I. W., Echols, N., Headd, J. J., Hung, L. W., Kapral, G. J., Grosse-Kunstleve, R. W., et al. (2010). PHENIX: a comprehensive Python-based system for macromolecular structure solution. Acta Crystallogr D 66, 213-221.

Hoffenberg, S., Powell, R., Carpov, A., Wagner, D., Wilson, A., Kosakovsky Pond, S., Lindsay, R., Arendt, H., Destefano, J., Phogat, S., et al. (2013). Identification of an HIV-1 clade A envelope that exhibits broad antigenicity and neutralization sensitivity and elicits antibodies targeting three distinct epitopes. J Virol 87, 5372-5383.

Kulp, D. W., Subramaniam, S., Donald, J. E., Hannigan, B. T., Mueller, B. K., Grigoryan, G., and Senes, A. (2012). Structural informatics, modeling, and design with an open-source Molecular Software Library (MSL). Journal of computational chemistry 33, 1645-1661.

McCoy, A. J., Grosse-Kunstleve, R. W., Adams, P. D., Winn, M. D., Storoni, L. C., and Read, R. J. (2007). Phaser crystallographic software. J Appl Crystallogr 40, 658-674.

Murshudov, G. N., Skubak, P., Lebedev, A. A., Pannu, N. S., Steiner, R. A., Nicholls, R. A., Winn, M. D., Long, F., and Vagin, A. A. (2011). REFMAC5 for the refinement of macromolecular crystal structures. Acta Crystallogr D 67, 355-367.

Ogura, T., Iwasaki, K., and Sato, C. (2003). Topology representing network enables highly accurate classification of protein images taken by cryo electron-microscope without masking. Journal of structural biology 143, 185-200.

Otwinowski, Z., and Minor, W. (1997). Processing of X-ray diffraction data collected in oscillation mode. Method Enzymol 276, 307-326.

Quan, J., and Tian, J. (2014). Circular polymerase extension cloning. Methods in molecular biology 1116, 103-117.

Ringe, R. P., Sanders, R. W., Yasmeen, A., Kim, H. J., Lee, J. H., Cupo, A., Korzun, J., Derking, R., van Montfort, T., Julien, J. P., et al. (2013). Cleavage strongly influences whether soluble HIV-1 envelope glycoprotein trimers adopt a native-like conformation. Proceedings of the National Academy of Sciences of the United States of America 110, 18256-18261.

Salmon, P., and Trono, D. (2007). Production and titration of lentiviral vectors. Current protocols in human genetics/editorial board, Jonathan L Haines [et al] Chapter 12, Unit 12 10.

Schiffner, T., de Val, N., Russell, R. A., de Taeye, S. W., de la Pena, A. T., Ozorowski, G., Kim, H. J., Nieusma, T., Brod, F., Cupo, A., et al. (2016). Chemical Cross-Linking Stabilizes Native-Like HIV-1 Envelope Glycoprotein Trimer Antigens. Journal of virology 90, 813-828.

Having thus described in detail preferred embodiments of the present invention, it is to be understood that the invention defined by the above paragraphs is not to be limited to particular details set forth in the above description as many apparent variations thereof are possible without departing from the spirit or scope of the present invention.

Although the present invention and its advantages have been described in detail, it should be understood that various changes, substitutions and alterations can be made herein without departing from the spirit and scope of the invention as defined in the appended claims.

SEQUENCE LISTING (165 sequences)

SEQ ID NO: 1 - protein, 448 aa, Artificial Sequence
  Description of Artificial Sequence: Synthetic polypeptide
VWKDAETTLFCASDAKAYETEKHNVWATHACVPTDPNPQEIHLENVTEEFNMWKNNMVEQMHTDIISAWDQSLKPCVKLTPLCVTLQCTNVANNIIDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEP

SEQ ID NO: 2 - DNA, 1344 bp, Artificial Sequence
  Description of Artificial Sequence: Synthetic polynucleotide
gtgtggaaagacgccgagactactctgttctgtgccagcgacgccaaagcatacgaaactgaaaagcataatgtgtgggctactcacgcctgcgtgcccacagacccaaatccccaggaaatccacctggagaatgtcactgaggaattcaacatgtggaagaacaatatggtggagcagatgcataccgacatcatttcagcctgggatcagagcctgaagccatgcgtgaaactgactcccctgtgcgtcaccctgcagtgtaccaacgtggccaacaatatcatcgacgatatgcggggcgaactgaagaattgttctttcaacatgaccacagagctgcgggacaagaaacagaaagtgtacagtctgttttatagactggatgtggtccagatcaatgaaaaccaggggaatcgatccaacaattctaacaaggagtaccggctgatcaattgcaacactagcgccattacccaggcttgtcccaaagtgtcctttgaacctatcccaattcattattgcgcccctgctggcttcgccatcctgaagtgtaaagataagaagttcaacggcaccgggccctgcccttctgtgagtacagtccagtgtactcacgggattaagcctgtggtcagtacacagctgctgctgaatggatcactggctgaggaagaagtgatgatccgatccgagaacattactaacaatgcaaagaatatcctggtgcagttcaacacccctgtccagattaattgcactcgcccaaacaataacacccggaaaagcatcagaattggaccaggccaggcattttacgccaccggggacatcattggagatatcagacaggcacactgtaatgtgtccaaggccacctggaacgaaacactgggaaaggtggtcaaacagctgagaaaacatttcggcaataacactatcattaggtttgctaatagctccggcggggacctggaagtgactacccacagcttcaactgcggaggcgagttcttttactgtaacacatccggcctgtttaattctacatggatcagtaacacttcagtgcagggctcaaatagcaccgggagcaacgattccatcacactgccttgccgcattaagcagatcattaatatgtggcagcgaattggacaggctatgtatgcaccccctatccagggcgtgattagatgtgtctctaatatcaccgggctgattctgacacgcgacgggggatctacaaacagtacaactgagactttcaggccaggcgggggagacatgagggataactggcgcagcgaactgtacaagtataaagtggtcaaaatcgagccc

SEQ ID NO: 3 - protein, 448 aa, Artificial Sequence
  Description of Artificial Sequence: Synthetic polypeptide
VWKDAETTLFCASDAKAYETEKHNVWATHACVPTDPNPQEIHLENVTEEFNMWKNNMVEQMHTDIISAWDQSLKPCVKLTPLCVTLQCTNYTPNLTNDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEP

SEQ ID NO: 4 - DNA, 1344 bp, Artificial Sequence
  Description of Artificial Sequence: Synthetic polynucleotide
gtgtggaaagacgccgagactactctgttctgtgccagcgacgccaaagcatacgaaactgaaaagcataatgtgtgggctactcacgcctgcgtgcccacagacccaaatccccaggaaatccacctggagaatgtcactgaggaattcaacatgtggaagaacaatatggtggagcagatgcataccgacatcatttcagcctgggatcagagcctgaagccatgcgtgaaactgactcccctgtgcgtcaccctgcagtgtaccaactacacacccaatctgaccaacgatatgcggggcgaactgaagaattgttctttcaacatgaccacagagctgcgggacaagaaacagaaagtgtacagtctgttttatagactggatgtggtccagatcaatgaaaaccaggggaatcgatccaacaattctaacaaggagtaccggctgatcaattgcaacactagcgccattacccaggcttgtcccaaagtgtcctttgaacctatcccaattcattattgcgcccctgctggcttcgccatcctgaagtgtaaagataagaagttcaacggcaccgggccctgcccttctgtgagtacagtccagtgtactcacgggattaagcctgtggtcagtacacagctgctgctgaatggatcactggctgaggaagaagtgatgatccgatccgagaacattactaacaatgcaaagaatatcctggtgcagttcaacacccctgtccagattaattgcactcgcccaaacaataacacccggaaaagcatcagaattggaccaggccaggcattttacgccaccggggacatcattggagatatcagacaggcacactgtaatgtgtccaaggccacctggaacgaaacactgggaaaggtggtcaaacagctgagaaaacatttcggcaataacactatcattaggtttgctaatagctccggcggggacctggaagtgactacccacagcttcaactgcggaggcgagttcttttactgtaacacatccggcctgtttaattctacatggatcagtaacacttcagtgcagggctcaaatagcaccgggagcaacgattccatcacactgccttgccgcattaagcagatcattaatatgtggcagcgaattggacaggctatgtatgcaccccctatccagggcgtgattagatgtgtctctaatatcaccgggctgattctgacacgcgacgggggatctacaaacagtacaactgagactttcaggccaggcgggggagacatgagggataactggcgcagcgaactgtacaagtataaagtggtcaaaatcgagccc

SEQ ID NO: 5 - protein, 448 aa, Artificial Sequence
  Description of Artificial Sequence: Synthetic polypeptide
VWKDAETTLFCASDAKAYETEKHNVWATHACVPTDPNPQEIHLENVTEEFNMWKNNMVEQMHTDIISAWDQSLKPCVKLTPLCVTLQCTNYAPNLINDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEP

SEQ ID NO: 6 - DNA, 1344 bp, Artificial Sequence
  Description of Artificial Sequence: Synthetic polynucleotide
gtgtggaaagacgccgagactactctgttctgtgccagcgacgccaaagcatacgaaactgaaaagcataatgtgtgggctactcacgcctgcgtgcccacagacccaaatccccaggaaatccacctggagaatgtcactgaggaattcaacatgtggaagaacaatatggtggagcagatgcataccgacatcatttcagcctgggatcagagcctgaagccatgcgtgaaactgactcccctgtgcgtcaccctgcagtgtaccaactacgcccccaatctgatcaacgatatgcggggcgaactgaagaattgttctttcaacatgaccacagagctgcgggacaagaaacagaaagtgtacagtctgttttatagactggatgtggtccagatcaatgaaaaccaggggaatcgatccaacaattctaacaaggagtaccggctgatcaattgcaacactagcgccattacccaggcttgtcccaaagtgtcctttgaacctatcccaattcattattgcgcccctgctggcttcgccatcctgaagtgtaaagataagaagttcaacggcaccgggccctgcccttctgtgagtacagtccagtgtactcacgggattaagcctgtggtcagtacacagctgctgctgaatggatcactggctgaggaagaagtgatgatccgatccgagaacattactaacaatgcaaagaatatcctggtgcagttcaacacccctgtccagattaattgcactcgcccaaacaataacacccggaaaagcatcagaattggaccaggccaggcattttacgccaccggggacatcattggagatatcagacaggcacactgtaatgtgtccaaggccacctggaacgaaacactgggaaaggtggtcaaacagctgagaaaacatttcggcaataacactatcattaggtttgctaatagctccggcggggacctggaagtgactacccacagcttcaactgcggaggcgagttcttttactgtaacacatccggcctgtttaattctacatggatcagtaacacttcagtgcagggctcaaatagcaccgggagcaacgattccatcacactgccttgccgcattaagcagatcattaatatgtggcagcgaattggacaggctatgtatgcaccccctatccagggcgtgattagatgtgtctctaatatcaccgggctgattctgacacgcgacgggggatctacaaacagtacaactgagactttcaggccaggcgggggagacatgagggataactggcgcagcgaactgtacaagtataaagtggtcaaaatcgagccc

SEQ ID NO: 7 - protein, 448 aa, Artificial Sequence
  Description of Artificial Sequence: Synthetic polypeptide
VWKDAETTLFCASDAKAYETEKHNVWATHACVPTDPNPQEIHLENVTEEFNMWKNNMVEQMHTDIISAWDQSLKPCVKLTPLCVTLQCTNYAPFLINDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYAFGDIIGDIRMAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEP

SEQ ID NO: 8 - DNA, 1344 bp, Artificial Sequence
  Description of Artificial Sequence: Synthetic polynucleotide
gtgtggaaagacgccgagactactctgttctgtgccagcgacgccaaagcatacgaaactgaaaagcataatgtgtgggctactcacgcctgcgtgcccacagacccaaatccccaggaaatccacctggagaatgtcactgaggaattcaacatgtggaagaacaatatggtggagcagatgcataccgacatcatttcagcctgggatcagagcctgaagccatgcgtgaaactgactcccctgtgcgtcaccctgcagtgtaccaactacgcccccttcctgatcaacgatatgcggggcgaactgaagaattgttctttcaacatgaccacagagctgcgggacaagaaacagaaagtgtacagtctgttttatagactggatgtggtccagatcaatgaaaaccaggggaatcgatccaacaattctaacaaggagtaccggctgatcaattgcaacactagcgccattacccaggcttgtcccaaagtgtcctttgaacctatcccaattcattattgcgcccctgctggcttcgccatcctgaagtgtaaagataagaagttcaacggcaccgggccctgcccttctgtgagtacagtccagtgtactcacgggattaagcctgtggtcagtacacagctgctgctgaatggatcactggctgaggaagaagtgatgatccgatccgagaacattactaacaatgcaaagaatatcctggtgcagttcaacacccctgtccagattaattgcactcgcccaaacaataacacccggaaaagcatcagaattggaccaggccaggcattttacgccttcggggacatcattggagatatcagaatggcacactgtaatgtgtccaaggccacctggaacgaaacactgggaaaggtggtcaaacagctgagaaaacatttcggcaataacactatcattaggtttgctaatagctccggcggggacctggaagtgactacccacagcttcaactgcggaggcgagttcttttactgtaacacatccggcctgtttaattctacatggatcagtaacacttcagtgcagggctcaaatagcaccgggagcaacgattccatcacactgccttgccgcattaagcagatcattaatatgtggcagcgaattggacaggctatgtatgcaccccctatccagggcgtgattagatgtgtctctaatatcaccgggctgattctgacacgcgacgggggatctacaaacagtacaactgagactttcaggccaggcgggggagacatgagggataactggcgcagcgaactgtacaagtataaagtggtcaaaatcgagccc

SEQ ID NO: 9 - protein, 448 aa, Artificial Sequence
  Description of Artificial Sequence: Synthetic polypeptide
VWKDAETTLFCASDAKAYETEKHNVWATHACVPTDPNPQEIHLENVTEEFNMWKNNMVEQMHTDIISAWDQSLKPCVKLTPLCVTLQCTNYAPFLINNMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYAFGDIIGDIRMAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEP

SEQ ID NO: 10 - DNA, 1344 bp, Artificial Sequence
  Description of Artificial Sequence: Synthetic polynucleotide
gtgtggaaagacgccgagactactctgttctgtgccagcgacgccaaagcatacgaaactgaaaagcataatgtgtgggctactcacgcctgcgtgcccacagacccaaatccccaggaaatccacctggagaatgtcactgaggaattcaacatgtggaagaacaatatggtggagcagatgcataccgacatcatttcagcctgggatcagagcctgaagccatgcgtgaaactgactcccctgtgcgtcaccctgcagtgtaccaactacgcccccttcctgatcaacaacatgcggggcgaactgaagaattgttctttcaacatgaccacagagctgcgggacaagaaacagaaagtgtacagtctgttttatagactggatgtggtccagatcaatgaaaaccaggggaatcgatccaacaattctaacaaggagtaccggctgatcaattgcaacactagcgccattacccaggcttgtcccaaagtgtcctttgaacctatcccaattcattattgcgcccctgctggcttcgccatcctgaagtgtaaagataagaagttcaacggcaccgggccctgcccttctgtgagtacagtccagtgtactcacgggattaagcctgtggtcagtacacagctgctgctgaatggatcactggctgaggaagaagtgatgatccgatccgagaacattactaacaatgcaaagaatatcctggtgcagttcaacacccctgtccagattaattgcactcgcccaaacaataacacccggaaaagcatcagaattggaccaggccaggcattttacgccttcggggacatcattggagatatcagaatggcacactgtaatgtgtccaaggccacctggaacgaaacactgggaaaggtggtcaaacagctgagaaaacatttcggcaataacactatcattaggtttgctaatagctccggcggggacctggaagtgactacccacagcttcaactgcggaggcgagttcttttactgtaacacatccggcctgtttaattctacatggatcagtaacacttcagtgcagggctcaaatagcaccgggagcaacgattccatcacactgccttgccgcattaagcagatcattaatatgtggcagcgaattggacaggctatgtatgcaccccctatccagggcgtgattagatgtgtctctaatatcaccgggctgattctgacacgcgacgggggatctacaaacagtacaactgagactttcaggccaggcgggggagacatgagggataactggcgcagcgaactgtacaagtataaagtggtcaaaatcgagccc

SEQ ID NO: 11 - protein, 448 aa, Artificial Sequence
  Description of Artificial Sequence: Synthetic polypeptide
VWKDAETTLFCASDAKAYETEKHNVWATHACVPTDPNPQEIHLENVTEEFNMWKNNMVEQMHTDIISAWDQSLKPCVKLTPLCVTLQCTNYAPNLLSNMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYAFGDIIGDIRMAHCNVSKATWNETLGKVVKQLRKHFGNNTIIRFANSSGGDLEVTTHSFNCGGEFFYCNTSGLFNSTWISNTSVQGSNSTGSNDSIVLPCRIKQIINMWQRIGQAMYAPPIQGVIRCVSNITGLILTRDGGSTNSTTETFRPGGGDMRDNWRSELYKYKVVKIEP

SEQ ID NO: 12 - DNA, 1344 bp, Artificial Sequence
  Description of Artificial Sequence: Synthetic polynucleotide
gtgtggaaagacgccgagactactctgttctgtgccagcgacgccaaagcatacgaaactgaaaagcataatgtgtgggctactcacgcctgcgtgcccacagacccaaatccccaggaaatccacctggagaatgtcactgaggaattcaacatgtggaagaacaatatggtggagcagatgcataccgacatcatttcagcctgggatcagagcctgaagccatgcgtgaaactgactcccctgtgcgtcaccctgcagtgtaccaactacgcccccaacctgctgagcaacatgcggggcgaactgaagaattgttctttcaacatgaccacagagctgcgggacaagaaacagaaagtgtacagtctgttttatagactggatgtggtccagatcaatgaaaaccaggggaatcgatccaacaattctaacaaggagtaccggctgatcaattgcaacactagcgccattacccaggcttgtcccaaagtgtcctttgaacctatcccaattcattattgcgcccctgctggcttcgccatcctgaagtgtaaagataagaagttcaacggcaccgggccctgcccttctgtgagtacagtccagtgtactcacgggattaagcctgtggtcagtacacagctgctgctgaatggatcactggctgaggaagaagtgatgatccgatccgagaacattactaacaatgcaaagaatatcctggtgcagttcaacacccctgtccagattaattgcactcgcccaaacaataacacccggaaaagcatcagaattggaccaggccaggcattttacgccttcggggacatcattggagatatcagaatggcacactgtaatgtgtccaaggccacctggaacgaaacactgggaaaggtggtcaaacagctgagaaaacatttcggcaataacactatcattaggtttgctaatagctccggcggggacctggaagtgactacccacagcttcaactgcggaggcgagttcttttactgtaacacatccggcctgtttaattctacatggatcagtaacacttcagtgcagggctcaaatagcaccgggagcaacgattccatcgtgctgccttgccgcattaagcagatcattaatatgtggcagcgaattggacaggctatgtatgcaccccctatccagggcgtgattagatgtgtctctaatatcaccgggctgattctgacacgcgacgggggatctacaaacagtacaactgagactttcaggccaggcgggggagacatgagggataactggcgcagcgaactgtacaagtataaagtggtcaaaatcgagccc

SEQ ID NO: 13 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVANNIIDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 14 - DNA, 1902 bp, Artificial Sequence
  Description of Artificial Sequence: Synthetic polynucleotide
gctgaaaacctgtgggtcactgtctactacggcgtgcctgtctggaaggatgctgaaactactctgttctgtgcctctgatgctaaagcctacgaaaccgagaagcacaatgtgtgggccacacatgcttgcgtccctactgacccaaacccccaggaaatccacctggagaatgtgacagaggaattcaacatgtggaaaaacaatatggtggagcagatgcatactgacatcatttccctgtgggatcagtctctgaagccttgcgtgaaactgacaccactgtgcgtcactctgcagtgtactaacgtggccaacaatatcatcgacgatatgcggggcgaactgaagaattgttctttcaacatgaccacagagctgcgggacaagaaacagaaagtgtacagtctgttttatagactggatgtggtccagatcaatgaaaaccaggggaatcgaagtaacaattcaaacaaggagtaccggctgatcaattgcaacacaagtgcaattactcaggcctgtccaaaagtgtcatttgaacctatcccaattcattattgcgctcccgcaggcttcgccatcctgaagtgtaaagataagaagttcaacggcaccgggccatgcccttcagtgagcaccgtccagtgtacacacggaattaagccagtggtctccacacagctgctgctgaatggctctctggctgaggaagaagtgatgatcaggagcgagaacattaccaacaatgcaaagaatatcctggtgcagttcaacacacccgtccagattaattgcacccgccctaacaataacacacggaaatctatcagaattggacccggccaggcattttatgccaccggcgacatcattggggatatcagacaggcacactgtaatgtgagcaaggccacttggaacgagaccctggggaaggtggtcaaacagctgagaaagcatttcggaaacaacactatcatcaggtttgccaatagctccggcggggacctggaagtgactacccacagcttcaactgcggaggcgagttcttttactgtaacacaagtggcctgtttaattcaacctggatcagcaacacatccgtgcagggatccaattctacaggctctaacgatagtatcactctgccctgccgcattaagcagatcattaatatgtggcagcgaatcgggcaggctatgtatgcaccccctatccagggagtgattagatgtgtcagcaatatcactggcctgattctgacccgcgacgggggatcaactaacagcacaactgagaccttccggcctggaggaggagacatgagggataactggcgctccgaactgtacaagtataaagtggtcaagatcgagccactgggagtggcaccaaccagatgcaaacgaagagtggtcggaaggcgacgacgaagaagggcagtgggaattggagctgtcttcctgggctttctgggggccgctggatctacaatgggggcagccagtatgaccctgacagtccaggctcgaaatctgctgtcaggaatcgtgcagcagcagagcaacctgctgagagcccctgaagctcagcagcatctgctgaagctgaccgtgtggggcatcaagcagctgcaggctagggtgctggcagtcgagcgctacctgcgagatcagcagctgctgggcatctgggggtgttccggaaagctgatttgctgtaccaatgtgccatggaactctagttggagcaatcgcaacctgtccgaaatctgggacaatatgacttggctgcagtgggataaggagattagcaactacacccagatcatctacggcctgctggaagagtcccagaatcagcaggagaagaacgagcaggacctgctggccctggat

SEQ ID NO: 15 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNYTPNLTNDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 16 - DNA, 1902 bp, Artificial Sequence
  Description of Artificial Sequence: Synthetic polynucleotide
gctgaaaacctgtgggtcactgtctactacggcgtgcctgtctggaaggatgctgaaactactctgttctgtgcctctgatgctaaagcctacgaaaccgagaagcacaatgtgtgggccacacatgcttgcgtccctactgacccaaacccccaggaaatccacctggagaatgtgacagaggaattcaacatgtggaaaaacaatatggtggagcagatgcatactgacatcatttccctgtgggatcagtctctgaagccttgcgtgaaactgacaccactgtgcgtcactctgcagtgtactaactacacccccaatctgaccaacgatatgcggggcgaactgaagaattgttctttcaacatgaccacagagctgcgggacaagaaacagaaagtgtacagtctgttttatagactggatgtggtccagatcaatgaaaaccaggggaatcgaagtaacaattcaaacaaggagtaccggctgatcaattgcaacacaagtgcaattactcaggcctgtccaaaagtgtcatttgaacctatcccaattcattattgcgctcccgcaggcttcgccatcctgaagtgtaaagataagaagttcaacggcaccgggccatgcccttcagtgagcaccgtccagtgtacacacggaattaagccagtggtctccacacagctgctgctgaatggctctctggctgaggaagaagtgatgatcaggagcgagaacattaccaacaatgcaaagaatatcctggtgcagttcaacacacccgtccagattaattgcacccgccctaacaataacacacggaaatctatcagaattggacccggccaggcattttatgccaccggcgacatcattggggatatcagacaggcacactgtaatgtgagcaaggccacttggaacgagaccctggggaaggtggtcaaacagctgagaaagcatttcggaaacaacactatcatcaggtttgccaatagctccggcggggacctggaagtgactacccacagcttcaactgcggaggcgagttcttttactgtaacacaagtggcctgtttaattcaacctggatcagcaacacatccgtgcagggatccaattctacaggctctaacgatagtatcactctgccctgccgcattaagcagatcattaatatgtggcagcgaatcgggcaggctatgtatgcaccccctatccagggagtgattagatgtgtcagcaatatcactggcctgattctgacccgcgacgggggatcaactaacagcacaactgagaccttccggcctggaggaggagacatgagggataactggcgctccgaactgtacaagtataaagtggtcaagatcgagccactgggagtggcaccaaccagatgcaaacgaagagtggtcggaaggcgacgacgaagaagggcagtgggaattggagctgtcttcctgggctttctgggggccgctggatctacaatgggggcagccagtatgaccctgacagtccaggctcgaaatctgctgtcaggaatcgtgcagcagcagagcaacctgctgagagcccctgaagctcagcagcatctgctgaagctgaccgtgtggggcatcaagcagctgcaggctagggtgctggcagtcgagcgctacctgcgagatcagcagctgctgggcatctgggggtgttccggaaagctgatttgctgtaccaatgtgccatggaactctagttggagcaatcgcaacctgtccgaaatctgggacaatatgacttggctgcagtgggataaggagattagcaactacacccagatcatctacggcctgctggaagagtcccagaatcagcaggagaagaacgagcaggacctgctggccctggat

SEQ ID NO: 17 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNYAPNLINDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 18 - DNA, 1902 bp, Artificial Sequence
  Description of Artificial Sequence: Synthetic polynucleotide
gctgaaaacctgtgggtcactgtctactacggcgtgcctgtctggaaggatgctgaaactactctgttctgtgcctctgatgctaaagcctacgaaaccgagaagcacaatgtgtgggccacacatgcttgcgtccctactgacccaaacccccaggaaatccacctggagaatgtgacagaggaattcaacatgtggaaaaacaatatggtggagcagatgcatactgacatcatttccctgtgggatcagtctctgaagccttgcgtgaaactgacaccactgtgcgtcactctgcagtgtactaactacgcccccaatctgatcaacgatatgcggggcgaactgaagaattgttctttcaacatgaccacagagctgcgggacaagaaacagaaagtgtacagtctgttttatagactggatgtggtccagatcaatgaaaaccaggggaatcgaagtaacaattcaaacaaggagtaccggctgatcaattgcaacacaagtgcaattactcaggcctgtccaaaagtgtcatttgaacctatcccaattcattattgcgctcccgcaggcttcgccatcctgaagtgtaaagataagaagttcaacggcaccgggccatgcccttcagtgagcaccgtccagtgtacacacggaattaagccagtggtctccacacagctgctgctgaatggctctctggctgaggaagaagtgatgatcaggagcgagaacattaccaacaatgcaaagaatatcctggtgcagttcaacacacccgtccagattaattgcacccgccctaacaataacacacggaaatctatcagaattggacccggccaggcattttatgccaccggcgacatcattggggatatcagacaggcacactgtaatgtgagcaaggccacttggaacgagaccctggggaaggtggtcaaacagctgagaaagcatttcggaaacaacactatcatcaggtttgccaatagctccggcggggacctggaagtgactacccacagcttcaactgcggaggcgagttcttttactgtaacacaagtggcctgtttaattcaacctggatcagcaacacatccgtgcagggatccaattctacaggctctaacgatagtatcactctgccctgccgcattaagcagatcattaatatgtggcagcgaatcgggcaggctatgtatgcaccccctatccagggagtgattagatgtgtcagcaatatcactggcctgattctgacccgcgacgggggatcaactaacagcacaactgagaccttccggcctggaggaggagacatgagggataactggcgctccgaactgtacaagtataaagtggtcaagatcgagccactgggagtggcaccaaccagatgcaaacgaagagtggtcggaaggcgacgacgaagaagggcagtgggaattggagctgtcttcctgggctttctgggggccgctggatctacaatgggggcagccagtatgaccctgacagtccaggctcgaaatctgctgtcaggaatcgtgcagcagcagagcaacctgctgagagcccctgaagctcagcagcatctgctgaagctgaccgtgtggggcatcaagcagctgcaggctagggtgctggcagtcgagcgctacctgcgagatcagcagctgctgggcatctgggggtgttccggaaagctgatttgctgtaccaatgtgccatggaactctagttggagcaatcgcaacctgtccgaaatctgggacaatatgacttggctgcagtgggataaggagattagcaactacacccagatcatctacggcctgctggaagagtcccagaatcagcaggagaagaacgagcaggacctgctggccctggat

SEQ ID NO: 19 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNYAPFLINDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYAFGDIIGDIRMAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 20 - DNA, 1902 bp, Artificial Sequence
  Description of Artificial Sequence: Synthetic polynucleotide
gctgaaaacctgtgggtcactgtctactacggcgtgcctgtctggaaggatgctgaaactactctgttctgtgcctctgatgctaaagcctacgaaaccgagaagcacaatgtgtgggccacacatgcttgcgtccctactgacccaaacccccaggaaatccacctggagaatgtgacagaggaattcaacatgtggaaaaacaatatggtggagcagatgcatactgacatcatttccctgtgggatcagtctctgaagccttgcgtgaaactgacaccactgtgcgtcactctgcagtgtactaactacgccccctttctgatcaacgatatgcggggcgaactgaagaattgttctttcaacatgaccacagagctgcgggacaagaaacagaaagtgtacagtctgttttatagactggatgtggtccagatcaatgaaaaccaggggaatcgaagtaacaattcaaacaaggagtaccggctgatcaattgcaacacaagtgcaattactcaggcctgtccaaaagtgtcatttgaacctatcccaattcattattgcgctcccgcaggcttcgccatcctgaagtgtaaagataagaagttcaacggcaccgggccatgcccttcagtgagcaccgtccagtgtacacacggaattaagccagtggtctccacacagctgctgctgaatggctctctggctgaggaagaagtgatgatcaggagcgagaacattaccaacaatgcaaagaatatcctggtgcagttcaacacacccgtccagattaattgcacccgccctaacaataacacacggaaatctatcagaattggacccggccaggcattttatgcctttggcgacatcattggggatatcagaatggcacactgtaatgtgagcaaggccacttggaacgagaccctggggaaggtggtcaaacagctgagaaagcatttcggaaacaacactatcatcaggtttgccaatagctccggcggggacctggaagtgactacccacagcttcaactgcggaggcgagttcttttactgtaacacaagtggcctgtttaattcaacctggatcagcaacacatccgtgcagggatccaattctacaggctctaacgatagtatcactctgccctgccgcattaagcagatcattaatatgtggcagcgaatcgggcaggctatgtatgcaccccctatccagggagtgattagatgtgtcagcaatatcactggcctgattctgacccgcgacgggggatcaactaacagcacaactgagaccttccggcctggaggaggagacatgagggataactggcgctccgaactgtacaagtataaagtggtcaagatcgagccactgggagtggcaccaaccagatgcaaacgaagagtggtcggaaggcgacgacgaagaagggcagtgggaattggagctgtcttcctgggctttctgggggccgctggatctacaatgggggcagccagtatgaccctgacagtccaggctcgaaatctgctgtcaggaatcgtgcagcagcagagcaacctgctgagagcccctgaagctcagcagcatctgctgaagctgaccgtgtggggcatcaagcagctgcaggctagggtgctggcagtcgagcgctacctgcgagatcagcagctgctgggcatctgggggtgttccggaaagctgatttgctgtaccaatgtgccatggaactctagttggagcaatcgcaacctgtccgaaatctgggacaatatgacttggctgcagtgggataaggagattagcaactacacccagatcatctacggcctgctggaagagtcccagaatcagcaggagaagaacgagcaggacctgctggccctggat

SEQ ID NO: 21 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNYAPFLINNMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYAFGDIIGDIRMAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 22 - DNA, 1902 bp, Artificial Sequence
  Description of Artificial Sequence: Synthetic polynucleotide
gctgaaaacctgtgggtcactgtctactacggcgtgcctgtctggaaggatgctgaaactactctgttctgtgcctctgatgctaaagcctacgaaaccgagaagcacaatgtgtgggccacacatgcttgcgtccctactgacccaaacccccaggaaatccacctggagaatgtgacagaggaattcaacatgtggaaaaacaatatggtggagcagatgcatactgacatcatttccctgtgggatcagtctctgaagccttgcgtgaaactgacaccactgtgcgtcactctgcagtgtactaactacgccccctttctgatcaacaacatgcggggcgaactgaagaattgttctttcaacatgaccacagagctgcgggacaagaaacagaaagtgtacagtctgttttatagactggatgtggtccagatcaatgaaaaccaggggaatcgaagtaacaattcaaacaaggagtaccggctgatcaattgcaacacaagtgcaattactcaggcctgtccaaaagtgtcatttgaacctatcccaattcattattgcgctcccgcaggcttcgccatcctgaagtgtaaagataagaagttcaacggcaccgggccatgcccttcagtgagcaccgtccagtgtacacacggaattaagccagtggtctccacacagctgctgctgaatggctctctggctgaggaagaagtgatgatcaggagcgagaacattaccaacaatgcaaagaatatcctggtgcagttcaacacacccgtccagattaattgcacccgccctaacaataacacacggaaatctatcagaattggacccggccaggcattttatgcctttggcgacatcattggggatatcagaatggcacactgtaatgtgagcaaggccacttggaacgagaccctggggaaggtggtcaaacagctgagaaagcatttcggaaacaacactatcatcaggtttgccaatagctccggcggggacctggaagtgactacccacagcttcaactgcggaggcgagttcttttactgtaacacaagtggcctgtttaattcaacctggatcagcaacacatccgtgcagggatccaattctacaggctctaacgatagtatcactctgccctgccgcattaagcagatcattaatatgtggcagcgaatcgggcaggctatgtatgcaccccctatccagggagtgattagatgtgtcagcaatatcactggcctgattctgacccgcgacgggggatcaactaacagcacaactgagaccttccggcctggaggaggagacatgagggataactggcgctccgaactgtacaagtataaagtggtcaagatcgagccactgggagtggcaccaaccagatgcaaacgaagagtggtcggaaggcgacgacgaagaagggcagtgggaattggagctgtcttcctgggctttctgggggccgctggatctacaatgggggcagccagtatgaccctgacagtccaggctcgaaatctgctgtcaggaatcgtgcagcagcagagcaacctgctgagagcccctgaagctcagcagcatctgctgaagctgaccgtgtggggcatcaagcagctgcaggctagggtgctggcagtcgagcgctacctgcgagatcagcagctgctgggcatctgggggtgttccggaaagctgatttgctgtaccaatgtgccatggaactctagttggagcaatcgcaacctgtccgaaatctgggacaatatgacttggctgcagtgggataaggagattagcaactacacccagatcatctacggcctgctggaagagtcccagaatcagcaggagaagaacgagcaggacctgctggccctggat

SEQ ID NO: 23 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNYAPNLLSNMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYAFGDIIGDIRMAHCNVSKATWNETLGKVVKQLRKHFGNNTIIRFANSSGGDLEVTTHSFNCGGEFFYCNTSGLFNSTWISNTSVQGSNSTGSNDSIVLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 24 - DNA, 1902 bp, Artificial Sequence
  Description of Artificial Sequence: Synthetic polynucleotide
gctgaaaacctgtgggtcactgtctactacggcgtgcctgtctggaaggatgctgaaactactctgttctgtgcctctgatgctaaagcctacgaaaccgagaagcacaatgtgtgggccacacatgcttgcgtccctactgacccaaacccccaggaaatccacctggagaatgtgacagaggaattcaacatgtggaaaaacaatatggtggagcagatgcatactgacatcatttccctgtgggatcagtctctgaagccttgcgtgaaactgacaccactgtgcgtcactctgcagtgtactaactacgccccaaacctgctgtccaatatgcggggcgaactgaagaattgttctttcaacatgaccacagagctgcgggacaagaaacagaaagtgtacagtctgttttatagactggatgtggtccagatcaatgaaaaccaggggaatcgaagtaacaattcaaacaaggagtaccggctgatcaattgcaacacaagtgcaattactcaggcctgtccaaaagtgtcatttgaacctatcccaattcattattgcgctcccgcaggcttcgccatcctgaagtgtaaagataagaagttcaacggcaccgggccatgcccttcagtgagcaccgtccagtgtacacacggaattaagccagtggtctccacacagctgctgctgaatggctctctggctgaggaagaagtgatgatcaggagcgagaacattaccaacaatgcaaagaatatcctggtgcagttcaacacacccgtccagattaattgcacccgccctaacaataacacacggaaatctatcagaattggacccggccaggcattttatgcctttggcgacatcattggggatatcagaatggcacactgtaatgtgagcaaggccacttggaacgagaccctggggaaggtggtcaaacagctgagaaagcatttcggaaacaacactatcatcaggtttgccaatagctccggcggggacctggaagtgactacccacagcttcaactgcggaggcgagttcttttactgtaacacaagtggcctgtttaattcaacctggatcagcaacacatccgtgcagggatccaattctacaggctctaacgatagtatcgtgctgccctgccgcattaagcagatcattaatatgtggcagcgaatcgggcaggctatgtatgcaccccctatccagggagtgattagatgtgtcagcaatatcactggcctgattctgacccgcgacgggggatcaactaacagcacaactgagaccttccggcctggaggaggagacatgagggataactggcgctccgaactgtacaagtataaagtggtcaagatcgagccactgggagtggcaccaaccagatgcaaacgaagagtggtcggaaggcgacgacgaagaagggcagtgggaattggagctgtcttcctgggctttctgggggccgctggatctacaatgggggcagccagtatgaccctgacagtccaggctcgaaatctgctgtcaggaatcgtgcagcagcagagcaacctgctgagagcccctgaagctcagcagcatctgctgaagctgaccgtgtggggcatcaagcagctgcaggctagggtgctggcagtcgagcgctacctgcgagatcagcagctgctgggcatctgggggtgttccggaaagctgatttgctgtaccaatgtgccatggaactctagttggagcaatcgcaacctgtccgaaatctgggacaatatgacttggctgcagtgggataaggagattagcaactacacccagatcatctacggcctgctggaagagtcccagaatcagcaggagaagaacgagcaggacctgctggccctggat

SEQ ID NO: 25 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 26 - DNA, 1902 bp, Artificial Sequence
  Description of Artificial Sequence: Synthetic polynucleotide
gccgaaaatctgtgggtgactgtctactatggcgtgcctgtctggaaggacgccgagaccacactgttctgtgcttccgatgctaaggcatacgaaaccgagaaacacaacgtgtgggcaacccatgcctgcgtcccaacagacccaaacccccaggaaatccacctggagaatgtgaccgaggagttcaacatgtggaagaacaatatggtggaacagatgcatgaggacatcatttccctgtgggatcagtctctgaagccttgcgtgaaactgaccccactgtgcgtgacactgcagtgtacaaacgtcactaacaatatcaccgacgatatgcggggcgaactgaagaattgttctttcaacatgactaccgagctgagggacaagaaacagaaagtgtacagtctgttttatcgcctggatgtggtccagatcaatgaaaaccaggggaatcgaagtaacaattcaaacaaggagtaccggctgattaattgcaacaccagtgccatcacacaggcttgtccaaaagtgtcattcgagcctatcccaattcattattgcgcccccgctggcttcgccatcctgaagtgtaaagataagaagttcaacggcaccgggccatgcccttcagtgagcactgtccagtgtacccacggaattaagcctgtggtctccacacagctgctgctgaatggctctctggctgaggaagaagtgatcattaggtctgagaacatcactaacaatgcaaagaatattctggtgcagctgaacacccccgtccagatcaattgcactcgccctaacaataacaccgtgaaatctatccgaattggacccggccaggctttttattacaccggcgacatcattggcgacatcagacaggcacactgcaatgtgagcaaggccacatggaacgagactctggggaaggtggtcaaacagctgcgcaaacatttcggaaataacacaatcattcgatttgcacagagcagcggaggggacctggaagtgacaactcacagcttcaattgcggaggcgagttcttttactgtaacactagtggcctgtttaattcaacttggatcagcaacacctccgtgcagggcagcaacagcaccggctctaacgatagtatcacactgccatgtcggattaagcagatcattaacatgtggcagagaatcgggcaggccatgtatgcaccccctatccagggagtgattcgatgcgtgagcaatatcacaggcctgattctgactagagacgggggatcaacaaacagcaccacagagactttccggcccggcggaggagacatgcgagataactggagatccgaactgtacaagtataaagtggtcaagatcgagccactgggcgtggctcccaccagatgcaaacgaagagtggtcgggaggcgccgacggagaagggctgtggggattggagcagtcagcctgggctttctgggggccgctggatctacaatgggggcagccagtatgactctgaccgtgcaggccaggaatctgctgtcaggaatcgtgcagcagcagagcaacctgctgagggctcccgaaccccagcagcacctgctgaaggacacccactggggcatcaagcagctgcaggcaagagtgctggccgtcgagcattacctgagggatcagcagctgctgggcatctggggatgcagcggaaagctgatttgctgtacaaatgtgccttggaactctagttggagcaatcgcaacctgtccgaaatctgggacaatatgacatggctgcagtgggataaggagattagcaactacactcagatcatctacggcctgctggaagagtcccagaatcagcaggagaagaacgagcaggacctgctggccctggat

SEQ ID NO: 27 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGWAILKCKDKKFNGTGPCPSVSTVQCTHGIKPVVSTQLLLNGSLAEEEVMIRSENITNNAKNILVQFNTPVQINCTRPNNNTVKSIRIGPGQAFYYTGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKDTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 28 - DNA, 1902 bp, Artificial Sequence
  Description of Artificial Sequence: Synthetic polynucleotide
gctgaaaacctgtgggtcactgtctactacggcgtgcctgtctggaaggatgctgaaactactctgttctgtgcctctgatgctaaagcctacgaaaccgagaagcacaatgtgtgggccacacatgcttgcgtccctactgacccaaacccccaggaaatccacctggagaatgtgacagaggaattcaacatgtggaaaaacaatatggtggagcagatgcatactgacatcatttccctgtgggatcagtctctgaagccttgcgtgaaactgacaccactgtgcgtcactctgcagtgtactaacgtgaccaacaatatcaccgacgatatgcggggcgaactgaagaattgttctttcaacatgaccacagagctgcgggacaagaaacagaaagtgtacagtctgttttatagactggatgtggtccagatcaatgaaaaccaggggaatcgaagtaacaattcaaacaaggagtaccggctgatcaattgcaacacaagtgcaattactcaggcctgtccaaaagtgtcatttgaacctatcccaattcattattgcgctcccgcaggctgggccatcctgaagtgtaaagataagaagttcaacggcaccgggccatgcccttcagtgagcaccgtccagtgtacacacggaattaagccagtggtctccacacagctgctgctgaatggctctctggctgaggaagaagtgatgatcaggagcgagaacattaccaacaatgcaaagaatatcctggtgcagttcaacacacccgtccagattaattgcacccgccctaacaataacacagtgaaatctatcagaattggacccggccaggcattttattacaccggcgacatcattggggatatcagacaggcacactgtaatgtgagcaaggccacttggaacgagaccctggggaaggtggtcaaacagctgagaaagcatttcggaaacaacactatcatcaggtttgccaatagctccggcggggacctggaagtgactacccacagcttcaactgcggaggcgagttcttttactgtaacacaagtggcctgtttaattcaacctggatcagcaacacatccgtgcagggatccaattctacaggctctaacgatagtatcactctgccctgccgcattaagcagatcattaatatgtggcagcgaatcgggcaggctatgtatgcaccccctatccagggagtgattagatgtgtcagcaatatcactggcctgattctgacccgcgacgggggatcaactaacagcacaactgagaccttccggcctggaggaggagacatgagggataactggcgctccgaactgtacaagtataaagtggtcaagatcgagccactgggagtggcaccaaccagatgcaaacgaagagtggtcggaaggcgacgacgaagaagggcagtgggaattggagctgtcttcctgggctttctgggggccgctggatctacaatgggggcagccagtatgaccctgacagtccaggctcgaaatctgctgtcaggaatcgtgcagcagcagagcaacctgctgagagcccctgaagctcagcagcatctgctgaaggacaccgtgtggggcatcaagcagctgcaggctagggtgctggcagtcgagcgctacctgcgagatcagcagctgctgggcatctgggggtgttccggaaagctgatttgctgtaccaatgtgccatggaactctagttggagcaatcgcaacctgtccgaaatctgggacaatatgacttggctgcagtgggataaggagattagcaactacacccagatcatctacggcctgctggaagagtcccagaatcagcaggagaagaacgagcaggacctgctggccctggat

SEQ ID NO: 29 - protein, 634 aa, Artificial Sequence
  Description of Artificial Sequence: Synthetic polypeptide
AENLWVTVYYGVPVWKDAETTLFCASDAKAYETEKHNVWATHECVPTDPNPQEIHLENVTEEFNMWKNNMVEQMHTDIIELWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 30 - DNA, 1902 bp, Artificial Sequence
  Description of Artificial Sequence: Synthetic polynucleotide
gctgaaaacctgtgggtcactgtctactacggcgtgcctgtctggaaggatgctgaaactactctgttctgtgcctctgatgctaaagcctacgaaaccgagaagcacaatgtgtgggccacacatgagtgcgtccctactgacccaaacccccaggaaatccacctggagaatgtgacagaggaattcaacatgtggaaaaacaatatggtggagcagatgcatactgacatcattgagctgtgggatcagtctctgaagccttgcgtgaaactgacaccactgtgcgtcactctgcagtgtactaacgtgaccaacaatatcaccgacgatatgcggggcgaactgaagaattgttctttcaacatgaccacagagctgcgggacaagaaacagaaagtgtacagtctgttttatagactggatgtggtccagatcaatgaaaaccaggggaatcgaagtaacaattcaaacaaggagtaccggctgatcaattgcaacacaagtgcaattactcaggcctgtccaaaagtgtcatttgaacctatcccaattcattattgcgctcccgcaggcttcgccatcctgaagtgtaaagataagaagttcaacggcaccgggccatgcccttcagtgagcaccgtccagtgtacacacggaattaagccagtggtctccacacagctgctgctgaatggctctctggctgaggaagaagtgatgatcaggagcgagaacattaccaacaatgcaaagaatatcctggtgcagttcaacacacccgtccagattaattgcacccgccctaacaataacacacggaaatctatcagaattggacccggccaggcattttatgccaccggcgacatcattggggatatcagacaggcacactgtaatgtgagcaaggccacttggaacgagaccctggggaaggtggtcaaacagctgagaaagcatttcggaaacaacactatcatcaggtttgccaatagctccggcggggacctggaagtgactacccacagcttcaactgcggaggcgagttcttttactgtaacacaagtggcctgtttaattcaacctggatcagcaacacatccgtgcagggatccaattctacaggctctaacgatagtatcactctgccctgccgcattaagcagatcattaatatgtggcagcgaatcgggcaggctatgtatgcaccccctatccagggagtgattagatgtgtcagcaatatcactggcctgattctgacccgcgacgggggatcaactaacagcacaactgagaccttccggcctggaggaggagacatgagggataactggcgctccgaactgtacaagtataaagtggtcaagatcgagccactgggagtggcaccaaccagatgcaaacgaagagtggtcggaaggcgacgacgaagaagggcagtgggaattggagctgtcttcctgggctttctgggggccgctggatctacaatgggggcagccagtatgaccctgacagtccaggctcgaaatctgctgtcaggaatcgtgcagcagcagagcaacctgctgagagcccctgaagctcagcagcatctgctgaagctgaccgtgtggggcatcaagcagctgcaggctagggtgctggcagtcgagcgctacctgcgagatcagcagctgctgggcatctgggggtgttccggaaagctgatttgctgtaccaatgtgccatggaactctagttggagcaatcgcaacctgtccgaaatctgggacaatatgacttggctgcagtgggataaggagattagcaactacacccagatcatctacggcctgctggaagagtcccagaatcagcaggagaagaacgagcaggacctgctggccctggat

SEQ ID NO: 31 - protein, 634 aa, Artificial Sequence
  Description of Artificial Sequence: Synthetic polypeptide
AENLWVTVYYGVPVWKDAETTLFCASDAKAYETEKHNVWATHECVPTDPNPQEIHLENVTEEFNMWKNNMVEQMHTDIIELWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKLTVWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 32 - DNA, 1902 bp, Artificial Sequence
  Description of Artificial Sequence: Synthetic polynucleotide
gccgagaatctgtgggtgaccgtgtactatggcgtgcccgtgtggaaggacgcagagaccacactgttctgcgccagcgatgccaaggcctacgagacagagaagcacaacgtgtgggccacccacgagtgcgtgcctacagacccaaacccccaggagatccacctggagaatgtgaccgaggagtttaacatgtggaagaacaatatggtggagcagatgcacacagacatcatcgagctgtgggatcagtccctgaagccctgcgtgaagctgacccctctgtgcgtgacactgcagtgtaccaacgtgacaaacaatatcaccgacgatatgaggggcgagctgaagaattgtagcttcaacatgaccacagagctgcgggacaagaagcagaaggtgtactccctgttttatagactggatgtggtgcagatcaatgagaaccagggcaataggtctaacaatagcaacaaggagtaccgcctgatcaattgcaacacctctgccatcacacaggcctgtcctaaggtgagcttcgagcctatcccaatccactattgcgccccagccggcttcgccatcctgaagtgtaaggataagaagtttaacggcaccggcccatgcccttccgtgtctaccgtgcagtgtacacacggcatcaagcctgtggtgagcacacagctgctgctgaatggctccctggccgaggaggaagtgatcatccggagcgagaacatcaccaacaatgccaagaatatcctggtgcagctgaacacaccagtgcagatcaattgcaccaggcccaacaataacacagtgaagtctatccgcatcggcccaggccaggccttttactataccggcgacatcatcggcgacatcagacaggcccactgtaatgtgagcaaggccacctggaacgagacactgggcaaggtggtgaagcagctgcggaagcacttcggcaataacaccatcatcagatttgcacagagcagcggaggcgacctggaggtgaccacacactccttcaattgcggcggcgagttcttttactgtaacacatccggcctgtttaattctacctggatctccaacacatctgtgcagggcagcaattccaccggcagcaacgattccatcacactgccatgcaggatcaagcagatcatcaacatgtggcagaggatcggacaggcaatgtatgcaccacctatccagggcgtgatcagatgcgtgagcaatatcaccggcctgatcctgacacgcgacggaggctctaccaacagcaccacagagacattcaggcccggcggaggcgacatgagggataactggagatctgagctgtacaagtataaggtggtgaagatcgagcctctgggagtggcaccaaccaggtgcaagaggagagtggtgggcaggcgccggagaaggcgcgcagtgggcatcggagccgtgagcctgggctttctgggagcagcaggcagcacaatgggcgcagccagcatgaccctgacagtgcaggcccggaatctgctgtccggcatcgtgcagcagcagtctaacctgctgagagccccagagccccagcagcacctgctgaagctgaccgtgtggggcatcaagcagctgcaggccagagtgctggccgtggagcactacctgagagatcagcagctgctgggcatctggggatgctccggcaagctgatctgctgtaccaatgtgccctggaactctagctggagcaatagaaacctgtccgagatctgggacaatatgacctggctgcagtgggataaggagatctccaactacacacagatcatctatggcctgctggaggagtctcagaatcagcaggagaagaacgagcaggacctgctggccctggat

SEQ ID NO: 33 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPERQQHLLKDTVWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 34 - DNA, 1902 bp, Artificial Sequence
  Description of Artificial Sequence: Synthetic polynucleotide
gctgaaaacctgtgggtcactgtctactacggcgtgcctgtctggaaggatgctgaaactactctgttctgtgcctctgatgctaaagcctacgaaaccgagaagcacaatgtgtgggccacacatgcttgcgtccctactgacccaaacccccaggaaatccacctggagaatgtgacagaggaattcaacatgtggaaaaacaatatggtggagcagatgcatactgacatcatttccctgtgggatcagtctctgaagccttgcgtgaaactgacaccactgtgcgtcactctgcagtgtactaacgtgaccaacaatatcaccgacgatatgcggggcgaactgaagaattgttctttcaacatgaccacagagctgcgggacaagaaacagaaagtgtacagtctgttttatagactggatgtggtccagatcaatgaaaaccaggggaatcgaagtaacaattcaaacaaggagtaccggctgatcaattgcaacacaagtgcaattactcaggcctgtccaaaagtgtcatttgaacctatcccaattcattattgcgctcccgcaggcttcgccatcctgaagtgtaaagataagaagttcaacggcaccgggccatgcccttcagtgagcaccgtccagtgtacacacggaattaagccagtggtctccacacagctgctgctgaatggctctctggctgaggaagaagtgatgatcaggagcgagaacattaccaacaatgcaaagaatatcctggtgcagttcaacacacccgtccagattaattgcacccgccctaacaataacacacggaaatctatcagaattggacccggccaggcattttatgccaccggcgacatcattggggatatcagacaggcacactgtaatgtgagcaaggccacttggaacgagaccctggggaaggtggtcaaacagctgagaaagcatttcggaaacaacactatcatcaggtttgccaatagctccggcggggacctggaagtgactacccacagcttcaactgcggaggcgagttcttttactgtaacacaagtggcctgtttaattcaacctggatcagcaacacatccgtgcagggatccaattctacaggctctaacgatagtatcactctgccctgccgcattaagcagatcattaatatgtggcagcgaatcgggcaggctatgtatgcaccccctatccagggagtgattagatgtgtcagcaatatcactggcctgattctgacccgcgacgggggatcaactaacagcacaactgagaccttccggcctggaggaggagacatgagggataactggcgctccgaactgtacaagtataaagtggtcaagatcgagccactgggagtggcaccaaccagatgcaaacgaagagtggtcggaaggcgacgacgaagaagggcagtgggaattggagctgtcttcctgggctttctgggggccgctggatctacaatgggggcagccagtatgaccctgacagtccaggctcgaaatctgctgtcaggaatcgtgcagcagcagagcaacctgctgagagcccctgaacggcagcagcatctgctgaaggacaccgtgtggggcatcaagcagctgcaggctagggtgctggcagtcgagcactacctgcgagatcagcagctgctgggcatctgggggtgttccggaaagctgatttgctgtaccaatgtgccatggaactctagttggagcaatcgcaacctgtccgaaatctgggacaatatgacttggctgcagtgggataaggagattagcaactacacccagatcatctacggcctgctggaagagtcccagaatcagcaggagaagaacgagcaggacctgctggccctggat

SEQ ID NO: 35 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKDTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 36 - DNA, 1902 bp, Artificial Sequence
  Description of Artificial Sequence: Synthetic polynucleotide
gctgaaaacctgtgggtcactgtctactacggcgtgcctgtctggaaggatgctgaaactactctgttctgtgcctctgatgctaaagcctacgaaaccgagaagcacaatgtgtgggccacacatgcttgcgtccctactgacccaaacccccaggaaatccacctggagaatgtgacagaggaattcaacatgtggaaaaacaatatggtggagcagatgcatactgacatcatttccctgtgggatcagtctctgaagccttgcgtgaaactgacaccactgtgcgtcactctgcagtgtactaacgtgaccaacaatatcaccgacgatatgcggggcgaactgaagaattgttctttcaacatgaccacagagctgcgggacaagaaacagaaagtgtacagtctgttttatagactggatgtggtccagatcaatgaaaaccaggggaatcgaagtaacaattcaaacaaggagtaccggctgatcaattgcaacacaagtgcaattactcaggcctgtccaaaagtgtcatttgaacctatcccaattcattattgcgctcccgcaggcttcgccatcctgaagtgtaaagataagaagttcaacggcaccgggccatgcccttcagtgagcaccgtccagtgtacacacggaattaagccagtggtctccacacagctgctgctgaatggctctctggctgaggaagaagtgatgatcaggagcgagaacattaccaacaatgcaaagaatatcctggtgcagttcaacacacccgtccagattaattgcacccgccctaacaataacacacggaaatctatcagaattggacccggccaggcattttatgccaccggcgacatcattggggatatcagacaggcacactgtaatgtgagcaaggccacttggaacgagaccctggggaaggtggtcaaacagctgagaaagcatttcggaaacaacactatcatcaggtttgccaatagctccggcggggacctggaagtgactacccacagcttcaactgcggaggcgagttcttttactgtaacacaagtggcctgtttaattcaacctggatcagcaacacatccgtgcagggatccaattctacaggctctaacgatagtatcactctgccctgccgcattaagcagatcattaatatgtggcagcgaatcgggcaggctatgtatgcaccccctatccagggagtgattagatgtgtcagcaatatcactggcctgattctgacccgcgacgggggatcaactaacagcacaactgagaccttccggcctggaggaggagacatgagggataactggcgctccgaactgtacaagtataaagtggtcaagatcgagccactgggagtggcaccaaccagatgcaaacgaagagtggtcggaaggcgacgacgaagaagggcagtgggaattggagctgtcttcctgggctttctgggggccgctggatctacaatgggggcagccagtatgaccctgacagtccaggctcgaaatctgctgtcaggaatcgtgcagcagcagagcaacctgctgagagcccctgaagctcagcagcatctgctgaaggacaccgtgtggggcatcaagcagctgcaggctagggtgctggcagtcgagcgctacctgcgagatcagcagctgctgggcatctgggggtgttccggaaagctgatttgctgtaccaatgtgccatggaactctagttggagcaatcgcaacctgtccgaaatctgggacaatatgacttggctgcagtgggataaggagattagcaactacacccagatcatctacggcctgctggaagagtcccagaatcagcaggagaagaacgagcaggacctgctggccctggat

SEQ ID NO: 37 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFWRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTAPNNFTVKSIRIGPGQAFYYMGDIIGDIRQAHCNVSKATWNETLGKVVKQLRKHFGNNTIIRFAQSSGGDLEVTTHSFNCGGMFFYCNTSGLFNSTWISNTSVQGSNSTGSNDSITLPCRIKLIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 38 - DNA, 1902 bp, Artificial Sequence
  Description of Artificial Sequence: Synthetic polynucleotide
gccgaaaacctgtgggtgactgtctactatggcgtgcccgtctggaaggacgcagagaccacactgttctgcgctagcgatgctaaggcctacgagaccgagaaacacaacgtgtgggcaacccatgcctgcgtgcctacagacccaaatccccaggaaatccacctggagaacgtgaccgaggagttcaacatgtggaagaacaatatggtggaacagatgcatgaggacatcatttccctgtgggatcagtctctgaagccctgcgtgaaactgacccctctgtgcgtcacactgcagtgtacaaacgtgactaacaatatcaccgacgatatgcggggcgaactgaagaactgttctttcaatatgactaccgagctgcgcgacaagaaacagaaagtgtacagtctgttttggcgactggatgtggtccagatcaacgaaaatcaggggaaccggagtaacaactcaaataaggagtatagactgatcaactgcaataccagtgccattacacaggcttgtcctaaagtgtcattcgagcctatcccaattcattactgcgccccagctggcttcgccatcctgaagtgtaaagataagaagttcaacggcaccgggccatgcccttcagtgagcactgtccagtgtacccacggaattaagcctgtggtctccacacagctgctgctgaacggctctctggctgaggaagaagtgatcattagatccgagaatatcactaacaatgcaaagaacattctggtgcagctgaataccccagtccagatcaactgcactgcccccaacaatttcaccgtgaaatctatccggattggaccaggccaggctttttactatatgggcgacatcattggggatattagacaggcacactgtaacgtgagcaaggccacatggaatgaaactctggggaaggtggtcaaacagctgcgaaaacatttcggaaacaatacaatcattcgatttgcacagagcagcggaggggacctggaggtgacaactcacagcttcaactgcggaggcatgttcttttattgtaatactagtggcctgtttaactcaacttggatcagcaatacctccgtgcagggcagcaacagcaccggctctaatgatagtatcacactgccatgcagaattaagctgatcattaatatgtggcagaggatcgggcaggctatgtacgcaccccctatccagggagtgattcggtgcgtgagcaacatcacaggcctgattctgactagagacgggggatcaacaaatagcaccacagagactttcaggcccggcggaggagacatgcgagataactggcgatccgaactgtacaagtataaagtggtcaagatcgagcctctgggagtggcaccaacccgatgcaaacgaagagtggtcgggaggcgccgacggagaagggctgtggggattggagcagtctctctgggctttctgggggccgctggatctacaatgggggcagccagtatgactctgaccgtccaggcaaggaacctgctgtcaggaatcgtgcagcagcagagcaatctgctgcgcgctccagaaccccagcagcacctgctgaaggacacccattggggcatcaagcagctgcaggcaagggtgctggcagtcgagcactacctgcgagatcagcagctgctgggcatctggggatgcagcggaaagctgatttgctgtacaaacgtgccctggaacagcagctggagcaaccggaatctgtccgaaatctgggacaacatgacatggctgcagtgggataaggagattagcaattacactcagatcatctacggcctgctggaagagtcccagaaccagcaggagaagaacgagcaggacctgctggccctggat

SEQ ID NO: 39 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFWRLDVVQINENQGNRSNNSNKEYRLINCNTSAITQACPKVSFEPIPIHYCAPAGFAILKCKDKKFNGTGPCPSVSTVQCTHGIKPVLSTQLLLNGSLAEEEVIVRSENITNNAKNILVQLNTPVQINCTAPNNFTVKSIRIGPGQAFYYMGDIIGDIRQAHCNVSKATWNETLGKVVKQLRKHFGNNTIIRFAQSSGGDLEVTTHSFNCGGMFFFCNTSGLFNSTWISNTSVQGSNSTGSNDSITLPCRIKLIINMWQRIGQAMYAPPIQGVIRCVSNITGLILTRDGGSTNSTTETFRPGGGDMRDVWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 40 - DNA, 1902 bp, Artificial Sequence
  Description of Artificial Sequence: Synthetic polynucleotide
gccgagaacctgtgggtgaccgtgtactatggcgtgcccgtgtggaaggacgcagagaccacactgttttgcgccagcgatgccaaggcctatgagacagagaagcacaacgtgtgggcaacccacgcatgcgtgcctacagacccaaatccccaggagatccacctggagaacgtgaccgaggagttcaatatgtggaagaacaatatggtggagcagatgcacgaggacatcatctccctgtgggatcagtctctgaagccctgcgtgaagctgacccctctgtgcgtgacactgcagtgtaccaacgtgacaaacaatatcaccgacgatatgcggggcgagctgaagaactgttcttttaatatgaccacagagctgagggacaagaagcagaaggtgtacagcctgttctggcgcctggatgtggtgcagatcaacgagaatcagggcaacaggtctaacaatagcaataaggagtatcgcctgatcaactgcaatacctccgccatcacacaggcctgtcctaaggtgtcttttgagcctatcccaatccactactgcgccccagccggctttgccatcctgaagtgtaaggataagaagttcaacggcaccggcccatgcccttccgtgtctaccgtgcagtgtacacacggcatcaagcctgtgctgtctacacagctgctgctgaacggcagcctggccgaggaggaagtgatcgtgcggagcgagaatatcaccaacaatgccaagaacatcctggtgcagctgaatacaccagtgcagatcaactgcaccgcccccaacaacttcaccgtgaagtccatccggatcggcccaggccaggccttctactatatgggcgacatcatcggcgacatcagacaggcccactgtaacgtgtctaaggccacctggaatgagacactgggcaaggtggtgaagcagctgaggaagcactttggcaacaataccatcatcaggttcgcacagagcagcggaggcgacctggaggtgaccacacactcctttaactgcggcggcatgttctttttctgtaatacaagcggcctgttcaactccacctggatctccaatacatctgtgcagggcagcaactccaccggcagcaatgattccatcacactgccatgccggatcaagctgatcatcaatatgtggcagagaatcggccaggccatgtatgcaccacctatccagggcgtgatcagatgcgtgagcaacatcaccggcctgatcctgacaagagacggcggctctaccaatagcaccacagagaccttccggcccggcggaggcgacatgagggacgtgtggagatccgagctgtacaagtataaggtggtgaagatcgagcctctgggagtggcaccaaccaggtgcaagaggagagtggtgggcaggcgccggagaaggcgcgcagtgggcatcggcgccgtgtctctgggcttcctgggagcagcaggcagcacaatgggcgcagcctctatgaccctgacagtgcaggccaggaacctgctgagcggcatcgtgcagcagcagtccaatctgctgcgcgccccagagccacagcagcacctgctgaaggacacccactggggcatcaagcagctgcaggccagagtgctggccgtggagcactacctgagagatcagcagctgctgggcatctggggatgctccggcaagctgatctgctgtaccaacgtgccctggaacagcagctggtctaaccggaatctgagcgagatctgggacaacatgacctggctgcagtgggataaggagatcagcaattacacacagatcatctatggcctgctggaggagtcccagaaccagcaggagaagaatgagcaggacctgctggccctggat

SEQ ID NO: 41 - protein, 635 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCCKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTRKSIRIGPGCAFYATGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQEHLHKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDD

SEQ ID NO: 42 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNYAPFLINNMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRMAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 43 - DNA, 1902 bp, Artificial Sequence
  Description of Artificial Sequence: Synthetic polynucleotide
gccgagaatctgtgggtgaccgtgtactatggcgtgcccgtgtggaaggacgcagagaccacactgttctgcgccagcgatgccaaggcctacgagacagagaagcacaacgtgtgggcaacccacgcatgcgtgcctacagacccaaacccccaggagatccacctggagaatgtgaccgaggagtttaacatgtggaagaacaatatggtggagcagatgcacgaggacatcatctccctgtgggatcagtctctgaagccctgcgtgaagctgacccctctgtgcgtgaccctgcagtgtacaaactatgcccccttcctgatcaacaatatgaggggcgagctgaagaattgttcttttaacatgaccacagagctgcgggacaagaagcagaaagtgtacagcctgttctatagactggatgtggtgcagatcaatgagaaccagggcaataggtctaacaatagcaacaaggagtaccgcctgatcaattgcaacacctccgccatcacacaggcctgtcctaaggtgtcttttgagcctatcccaatccactattgcgccccagccggcttcgccatcctgaagtgtaaggataagaagtttaacggcaccggcccatgcccttccgtgtctaccgtgcagtgtacacacggcatcaagcctgtggtgtctacacagctgctgctgaatggcagcctggccgaggaggaagtgatcatccggagcgagaacatcaccaacaatgccaagaatatcctggtgcagctgaacacaccagtgcagatcaattgcaccaggcccaacaataacacagtgaagtccatccgcatcggcccaggccaggccttctactataccggcgacatcatcggcgacatcagaatggcccactgtaacgtgagcaaggccacctggaacgagacactgggcaaggtggtgaagcagctgcggaagcacttcggcaataacaccatcatcagatttgcacagagcagcggaggcgacctggaggtgaccacacactccttcaattgcggcggcgagttcttttactgtaacacaagcggcctgtttaattccacctggatctccaacacatctgtgcagggcagcaattccaccggcagcaacgattccatcacactgccatgcaggatcaagcagatcatcaacatgtggcagaggatcggacaggcaatgtatgcaccacctatccagggcgtgatcagatgcgtgagcaatatcaccggcctgatcctgacacgcgacggaggctctaccaacagcaccacagagacattcaggcccggcggaggcgacatgagggataactggagatccgagctgtacaagtataaggtggtgaagatcgagcctctgggagtggcaccaaccaggtgcaagaggagagtggtgggcaggcgccggagaaggcgcgcagtgggcatcggagccgtgtctctgggctttctgggagcagcaggctccacaatgggcgcagcctctatgaccctgacagtgcaggcccggaatctgctgagcggcatcgtgcagcagcagtccaacctgctgagagccccagagccccagcagcacctgctgaaggacacccactggggcatcaagcagctgcaggccagagtgctggccgtggagcactacctgagagatcagcagctgctgggcatctggggatgctccggcaagctgatctgctgtaccaatgtgccttggaactctagctggtctaatagaaacctgagcgagatctgggacaatatgacctggctgcagtgggataaggagatcagcaactacacacagatcatctatggcctgctggaggagtcccagaatcagcaggagaagaacgagcaggacctgctggccctggat

SEQ ID NO: 44 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNYAPFLINDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYFGDIIGDIRMAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 45 - DNA, 1902 bp, Artificial Sequence
  Description of Artificial Sequence: Synthetic polynucleotide
gccgagaatctgtgggtgaccgtgtactatggcgtgcccgtgtggaaggacgcagagaccacactgttctgcgccagcgatgccaaggcctacgagacagagaagcacaacgtgtgggcaacccacgcatgcgtgcctacagacccaaacccccaggagatccacctggagaatgtgaccgaggagtttaacatgtggaagaacaatatggtggagcagatgcacgaggacatcatctccctgtgggatcagtctctgaagccctgcgtgaagctgacccctctgtgcgtgaccctgcagtgtacaaactatgcccccttcctgatcaacgatatgaggggcgagctgaagaattgttcttttaacatgaccacagagctgcgggacaagaagcagaaagtgtacagcctgttctatagactggatgtggtgcagatcaatgagaaccagggcaataggtctaacaatagcaacaaggagtaccgcctgatcaattgcaacacctccgccatcacacaggcctgtcctaaggtgtcttttgagcctatcccaatccactattgcgccccagccggcttcgccatcctgaagtgtaaggataagaagtttaacggcaccggcccatgcccttccgtgtctaccgtgcagtgtacacacggcatcaagcctgtggtgtctacacagctgctgctgaatggcagcctggccgaggaggaagtgatcatccggagcgagaacatcaccaacaatgccaagaatatcctggtgcagctgaacacaccagtgcagatcaattgcaccaggcccaacaataacacagtgaagtccatccgcatcggcccaggccaggccttctactattttggcgacatcatcggcgacatcagaatggcccactgtaacgtgagcaaggccacctggaacgagacactgggcaaggtggtgaagcagctgcggaagcacttcggcaataacaccatcatcagatttgcacagagcagcggaggcgacctggaggtgaccacacactccttcaattgcggcggcgagttcttttactgtaacacaagcggcctgtttaattccacctggatctccaacacatctgtgcagggcagcaattccaccggcagcaacgattccatcacactgccatgcaggatcaagcagatcatcaacatgtggcagaggatcggacaggcaatgtatgcaccacctatccagggcgtgatcagatgcgtgagcaatatcaccggcctgatcctgacacgcgacggaggctctaccaacagcaccacagagacattcaggcccggcggaggcgacatgagggataactggagatccgagctgtacaagtataaggtggtgaagatcgagcctctgggagtggcaccaaccaggtgcaagaggagagtggtgggcaggcgccggagaaggcgcgcagtgggcatcggagccgtgtctctgggctttctgggagcagcaggctccacaatgggcgcagcctctatgaccctgacagtgcaggcccggaatctgctgagcggcatcgtgcagcagcagtccaacctgctgagagccccagagccccagcagcacctgctgaaggacacccactggggcatcaagcagctgcaggccagagtgctggccgtggagcactacctgagagatcagcagctgctgggcatctggggatgctccggcaagctgatctgctgtaccaatgtgccttggaactctagctggtctaatagaaacctgagcgagatctgggacaatatgacctggctgcagtgggataaggagatcagcaactacacacagatcatctatggcctgctggaggagtcccagaatcagcaggagaagaacgagcaggacctgctggccctggat

SEQ ID NO: 46 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNYAPFLINNMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYFGDIIGDIRMAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 47 - DNA, 1902 bp, Artificial Sequence
  Description of Artificial Sequence: Synthetic polynucleotide
gccgagaatctgtgggtgaccgtgtactatggcgtgcccgtgtggaaggacgcagagaccacactgttctgcgccagcgatgccaaggcctacgagacagagaagcacaacgtgtgggcaacccacgcatgcgtgcctacagacccaaacccccaggagatccacctggagaatgtgaccgaggagtttaacatgtggaagaacaatatggtggagcagatgcacgaggacatcatctccctgtgggatcagtctctgaagccctgcgtgaagctgacccctctgtgcgtgaccctgcagtgtacaaactatgcccccttcctgatcaacaatatgaggggcgagctgaagaattgttcttttaacatgaccacagagctgcgggacaagaagcagaaagtgtacagcctgttctatagactggatgtggtgcagatcaatgagaaccagggcaataggtctaacaatagcaacaaggagtaccgcctgatcaattgcaacacctccgccatcacacaggcctgtcctaaggtgtcttttgagcctatcccaatccactattgcgccccagccggcttcgccatcctgaagtgtaaggataagaagtttaacggcaccggcccatgcccttccgtgtctaccgtgcagtgtacacacggcatcaagcctgtggtgtctacacagctgctgctgaatggcagcctggccgaggaggaagtgatcatccggagcgagaacatcaccaacaatgccaagaatatcctggtgcagctgaacacaccagtgcagatcaattgcaccaggcccaacaataacacagtgaagtccatccgcatcggcccaggccaggccttctactattttggcgacatcatcggcgacatcagaatggcccactgtaacgtgagcaaggccacctggaacgagacactgggcaaggtggtgaagcagctgcggaagcacttcggcaataacaccatcatcagatttgcacagagcagcggaggcgacctggaggtgaccacacactccttcaattgcggcggcgagttcttttactgtaacacaagcggcctgtttaattccacctggatctccaacacatctgtgcagggcagcaattccaccggcagcaacgattccatcacactgccatgcaggatcaagcagatcatcaacatgtggcagaggatcggacaggcaatgtatgcaccacctatccagggcgtgatcagatgcgtgagcaatatcaccggcctgatcctgacacgcgacggaggctctaccaacagcaccacagagacattcaggcccggcggaggcgacatgagggataactggagatccgagctgtacaagtataaggtggtgaagatcgagcctctgggagtggcaccaaccaggtgcaagaggagagtggtgggcaggcgccggagaaggcgcgcagtgggcatcggagccgtgtctctgggctttctgggagcagcaggctccacaatgggcgcagcctctatgaccctgacagtgcaggcccggaatctgctgagcggcatcgtgcagcagcagtccaacctgctgagagccccagagccccagcagcacctgctgaaggacacccactggggcatcaagcagctgcaggccagagtgctggccgtggagcactacctgagagatcagcagctgctgggcatctggggatgctccggcaagctgatctgctgtaccaatgtgccttggaactctagctggtctaatagaaacctgagcgagatctgggacaatatgacctggctgcagtgggataaggagatcagcaactacacacagatcatctatggcctgctggaggagtcccagaatcagcaggagaagaacgagcaggacctgctggccctggat

SEQ ID NO: 48 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNYAPNLLSNMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYFGDIIGDIRMAHCNVSKATWNETLGKVVKQLRKHFGNNTIIRFAQSSGGDLEVTTHSFNCGGEFFYCNTSGLFNSTWISNTSVQGSNSTGSNDSIVLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 49 - DNA, 1902 bp, Artificial Sequence
  Description of Artificial Sequence: Synthetic polynucleotide
gccgaaaacctgtgggtgactgtctattatggcgtgcccgtgtggaaagatgctgaaactactctgttctgtgcaagcgatgctaaggcctacgagacagagaagcacaacgtgtgggcaacccacgcatgcgtgcctacagacccaaatccccaggagatccacctggagaacgtgacagaggagttcaatatgtggaagaacaatatggtggagcagatgcacgaggacatcatctccctgtgggatcagtctctgaagccctgcgtgaagctgacccctctgtgcgtgaccctgcagtgtacaaattatgccccaaacctgctgtccaatatgaggggcgagctgaagaactgttctttcaatatgaccacagagctgcgggacaagaagcagaaggtgtacagcctgttttatagactggatgtggtgcagatcaatgagaaccagggcaacaggtctaacaatagcaataaggagtaccgcctgatcaattgcaacaccagcgccatcacacaggcctgtcctaaggtgtcctttgagcctatcccaatccactattgcgccccagccggcttcgccatcctgaagtgtaaggataagaagtttaacggcaccggcccatgcccttccgtgtctacagtgcagtgtacacacggcatcaagccagtggtgtctacacagctgctgctgaacggcagcctggccgaggaggaagtgatcatccggagcgagaatatcaccaacaatgccaagaacatcctggtgcagctgaatacaccagtgcagatcaactgcaccaggcccaacaataacacagtgaagtctatccgcatcggccccggccaggccttctactattttggcgacatcatcggcgatatcagaatggcccactgtaacgtgagcaaggccacctggaatgagacactgggcaaggtggtgaagcagctgcggaagcacttcggcaataacaccatcatcagatttgcacagtcctccggcggcgacctggaggtgaccacacactccttcaactgcggcggcgagttcttttactgtaataccagcggcctgtttaactccacctggatctccaatacatctgtgcagggcagcaactccacaggcagcaatgattccatcgtgctgccctgcaggatcaagcagatcatcaacatgtggcagcgcatcggccaggccatgtatgcccctcccatccagggcgtgatcagatgcgtgagcaacattaccggcctgatcctgacaagagatggcggatctaccaatagcacaaccgagacattcaggcccggcggcggcgacatgagagataactggagatctgagctgtacaagtataaggtggtgaagattgagcctctgggagtggcaccaacaagatgcaagagaagagtggtgggcaggcgccggagaaggcgcgcagtgggcattggagccgtgtccctgggctttctgggagcagcaggatccacaatgggagcagcctctatgaccctgacagtgcaggcccggaacctgctgagcggcatcgtgcagcagcagtccaatctgctgagagccccagagccccagcagcacctgctgaaggacacccactggggcatcaagcagctgcaggcacgggtgctggcagtggagcactacctgagagatcagcagctgctgggcatctggggctgtagcggcaagctgatctgctgtaccaacgtgccctggaattctagctggtctaatagaaacctgagcgagatctgggacaacatgacctggctgcagtgggataaggagatctccaattacacacagatcatctatggcctgctggaggaatcacagaatcagcaggaaaagaacgaacaggatctgctggcactggat

SEQ ID NO: 50 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTDWDNATLANMTGEIKNCSFNMTTELRDKKQKVYSLFYELDIIPIENEYISNNNTSNTSYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSATQWEQTLKGIAAKLLEHFGNNTIIRFAQSSGGDLEVTTHSFNCGGEFFYCNTSGLFNGSSWNLNKTKENTTNLENGTITLPCRIKQIINMWQRIGQAMYAPPIQGVIRCVSNITGLILTRDGGNKSAGIETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 51 - DNA, 1902 bp, Artificial Sequence
  Description of Artificial Sequence: Synthetic polynucleotide
gccgagaacctgtgggtgaccgtgtactatggcgtgcccgtgtggaaggacgcagagaccacactgttctgcgcctccgatgccaaggcctacgagacagagaagcacaacgtgtgggcaacccacgcatgcgtgcctacagacccaaatccccaggagatccacctggagaatgtgacagaggagtttaacatgtggaagaacaatatggtggagcagatgcacgaggacatcatctccctgtgggatcagtctctgaagccctgcgtgaagctgacccctctgtgcgtgaccctgcagtgtacagactgggataatgccaccctggccaacatgacaggcgagatcaagaattgttccttcaacatgaccacagagctgcgggacaagaagcagaaggtgtactctctgttttatgagctggacatcatccccatcgagaacgagtacatcagcaacaataacacctctaatacaagctatagactgatcaactgcaatacctctgccatcacacaggcctgtcctaaggtgagcttcgagcctatcccaatccactattgcgccccagccggcttcgccatcctgaagtgtaaggataagaagtttaacggcaccggcccatgccctagcgtgtccaccgtgcagtgtacacacggcatcaagcctgtggtgagcacacagctgctgctgaacggctccctggccgaggaggaagtgatcatcaggagcgagaatatcaccaataacgccaagaatatcctggtgcagctgaacacaccagtgcagatcaattgcacccggcccaataacaatacagtgaagtccatcagaatcggcccaggccaggccttttactataccggcgacatcatcggcgacatcaggcaggcccactgtaacgtgtctgccacccagtgggagcagacactgaagggcatcgccgccaagctgctggagcacttcggcaacaataccatcatcaggtttgcacagagcagcggaggcgacctggaggtgaccacacactccttcaattgcggcggcgagttcttttactgtaacacctctggcctgtttaatggctctagctggaacctgaataagacaaaggagaacaccacaaatctggagaacggcaccatcacactgccatgcaggatcaagcagatcatcaacatgtggcagaggatcggacaggcaatgtatgcaccacctatccagggcgtgatcagatgcgtgagcaacatcaccggcctgatcctgacaagagatggcggcaataagagcgccggcatcgagaccttccggcccggcggaggcgacatgagggataactggagatccgagctgtacaagtataaggtggtgaagatcgagcctctgggcgtggccccaacaagatgcaagaggagagtggtgggcaggcgccggagaaggcgcgcagtgggcatcggagccgtgagcctgggctttctgggagcagcaggcagcacaatgggcgcagccagcatgaccctgacagtgcaggccaggaacctgctgtccggcatcgtgcagcagcagtctaatctgctgcgcgccccagagccacagcagcacctgctgaaggacacccactggggcatcaagcagctgcaggccagggtgctggcagtggagcactacctgagggatcagcagctgctgggcatctggggatgcagcggcaagctgatctgctgtaccaatgtgccttggaactcctcttggagcaaccggaatctgtccgagatctgggacaacatgacctggctgcagtgggataaggagatcagcaattacacacagatcatctatggcctgctggaggagtcccagaatcagcaggagaagaacgagcaggacctgctggccctggat

SEQ ID NO: 52 - protein, 653 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCSDYEGNTTRQNITMKEEKGEIKNCSFNMTTELRDKKQKVYSLFYKLDITPIEEDNNSNNSSSANSSNSNANYTNYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSGTKWKNTLKQIVKKLGDHFGNNTIIRFAQSSGGDLEVTTHSFNCGGEFFYCNTSGLFNSTWNRTNGTWNDVEGLNYTNGNDTITLPCRIKQIINMWQRIGQAMYAPPIQGVIRCVSNITGLILTRDGGNDTDKNETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 53 - DNA, 1959 bp, Artificial Sequence
  Description of Artificial Sequence: Synthetic polynucleotide
gccgagaacctgtgggtgaccgtgtactatggcgtgcccgtgtggaaggacgcagagaccacactgttctgcgcctctgatgccaaggcctacgagacagagaagcacaacgtgtgggcaacccacgcatgcgtgcctacagacccaaacccccaggagatccacctggagaacgtgaccgaggagtttaatatgtggaagaacaatatggtggagcagatgcacgaggacatcatctctctgtgggatcagagcctgaagccctgcgtgaagctgacccctctgtgcgtgacactgcagtgtagcgactatgagggcaacaccacacggcagaatatcaccatgaaggaggagaagggcgagatcaagaactgttctttcaatatgaccacagagctgagagataagaagcagaaggtgtacagcctgttttataagctggacatcacccccatcgaggaggataacaattccaacaatagctcctctgccaatagctccaattctaacgccaattacacaaactataggctgatcaactgcaatacctctgccatcacacaggcctgtcctaaggtgagcttcgagcctatcccaatccactactgcgccccagccggcttcgccatcctgaagtgtaaggataagaagtttaacggcaccggcccatgccctagcgtgtccaccgtgcagtgtacacacggcatcaagcctgtggtgagcacacagctgctgctgaatggctccctggccgaggaggaagtgatcatccgctccgagaacatcaccaacaatgccaagaacatcctggtgcagctgaatacaccagtgcagatcaactgcacccggcccaacaataacacagtgaagtccatcagaatcggcccaggccaggccttttactataccggcgacatcatcggcgacatccggcaggcccactgtaacgtgagcggcaccaagtggaagaacacactgaagcagatcgtgaagaagctgggcgaccacttcggcaataacaccatcatcagatttgcccagtctagcggcggcgatctggaggtgaccacacacagcttcaattgcggcggcgagttcttttactgtaatacctccggcctgtttaactctacatggaaccggaccaatggcacatggaatgacgtggagggcctgaactataccaacggcaatgataccatcacactgccatgcaggatcaagcagatcatcaatatgtggcagaggatcggacaggcaatgtacgcaccacctatccagggcgtgatcagatgcgtgagcaacatcaccggcctgatcctgacaagagacggcggcaacgacaccgataagaatgagacattcaggcccggcggaggcgacatgagggataactggagatccgagctgtacaagtataaggtggtgaagatcgagcctctgggagtggcaccaaccaggtgcaagaggagagtggtgggcaggcgccggagaaggcgcgcagtgggcatcggagccgtgtccctgggctttctgggagcagcaggctctacaatgggcgcagccagcatgaccctgacagtgcaggccaggaatctgctgtccggcatcgtgcagcagcagtctaacctgctgcgcgccccagagccacagcagcacctgctgaaggacacccactggggcatcaagcagctgcaggccagggtgctggcagtggagcactatctgcgcgatcagcagctgctgggcatctggggatgcagcggcaagctgatctgctgtacaaacgtgccctggaacagcagctggagcaacaggaatctgtccgagatctgggacaatatgacctggctgcagtgggataaggagatcagcaactacacacagatcatctatggcctgctggaggagtcccagaaccagcaggagaagaatgagcaggacctgctggccctggat

SEQ ID NO: 54 - protein, 661 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCVTLKNCSNSNCSISRNISIEMDGEIKNCSFNMTTELRDKKQKVYSLFYRLDIVPIESSNNSQLSNNSQVSNNSQSSNYSQYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKKDWEKTLQQVATKLGQHFGNNTIIRFAQSSGGDLEVTTHSFNCGGEFFYCNTSGLFNSTWIRNSSNSTWNSSASNSTELNSNITLPCRIKQIINMWQRIGQAMYAPPIQGVIRCVSNITGLILTRDGGHETENKTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 55 - DNA, 1983 bp, Artificial Sequence
  Description of Artificial Sequence: Synthetic polynucleotide
gccgagaacctgtgggtgacagtgtactatggcgtgcccgtgtggaaggacgcagagaccacactgttctgcgccagcgatgccaaggcctacgagaccgagaagcacaacgtgtgggcaacacacgcatgcgtgcctaccgacccaaatccccaggagatccacctggagaatgtgaccgaggagtttaacatgtggaagaacaatatggtggagcagatgcacgaggacatcatctccctgtgggatcagtctctgaagccctgcgtgaagctgacccctctgtgcgtgacactgcagtgcgtgaccctgaagaactgcagcaattccaactgttctatcagcaggaatatctccatcgagatggatggcgagatcaagaattgttctttcaacatgaccacagagctgcgggacaagaagcagaaagtgtacagcctgttctaccggctggacatcgtgcccatcgagagcagcaacaattctcagctgagcaacaattcccaggtgtctaacaatagccagtctagcaactactcccagtatcgcctgatcaattgcaacacctctgccatcacacaggcctgtcctaaggtgagcttcgagcctatcccaatccactattgcgccccagccggcttcgccatcctgaagtgtaaggacaagaagtttaacggcacaggcccctgcccttccgtgtctaccgtgcagtgtacacacggcatcaagcctgtggtgtctacccagctgctgctgaacggcagcctggcagaggaggaagtgatcatccggagcgagaatatcacaaacaatgccaagaatatcctggtgcagctgaacaccccagtgcagatcaattgcacacggcccaacaataacaccgtgaagtccatcagaatcggcccaggccaggccttttactatacaggcgacatcatcggcgacatccggcaggcccactgtaacgtgtctaagaaggactgggagaagacactgcagcaggtggccaccaagctgggccagcacttcggcaataacaccatcatcagatttgcccagtcctctggcggcgatctggaggtgaccacacactccttcaattgcggcggcgagttcttttactgtaacacaagcggcctgtttaattccacctggatcagaaatagctccaactctacctggaacagcagcgccagcaactccacagagctgaatagcaacatcaccctgccatgcaggatcaagcagatcatcaacatgtggcagaggatcggacaggcaatgtatgcaccacctatccagggcgtgatcagatgcgtgagcaatatcacaggcctgatcctgacccgcgatggaggacacgagaccgagaacaagaccgagacattcaggcccggcggaggcgacatgagggataattggagatccgagctgtacaagtataaggtggtgaagatcgagcctctgggagtggcaccaacaaggtgcaagaggagagtggtgggcaggcgccggagaaggcgcgcagtgggcatcggagccgtgagcctgggctttctgggagcagcaggcagcacaatgggcgcagcctctatgaccctgacagtgcaggcccggaacctgctgagcggcatcgtgcagcagcagtccaatctgctgagagccccagagccccagcagcacctgctgaaggacacacactggggcatcaagcagctgcaggccagggtgctggcagtggagcactacctgagggatcagcagctgctgggcatctggggatgctccggcaagctgatctgctgtaccaatgtgccttggaactcctcttggtctaatcggaacctgagcgagatctgggacaacatgacatggctgcagtgggataaggagatcagcaattacacccagatcatctatggcctgctggaggagtcccagaatcagcaggagaagaacgagcaggacctgctggccctggat

SEQ ID NO: 56 - protein, 626 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNAALTNVTITNGPNITEEIRNCSFNMTTELRDKKQKVYSLFYKLDLVQINGSGGEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSGTKWNETLKQVAGKLRKHFGNNTIIRFAQSSGGDLEVTTHSFNCGGEFFYCNTSGLFNSTWPENGTMEGSNGTITLPCRIKQIINMWQRIGQAMYAPPIQGVIRCVSNITGLILTRDGGNSTTDTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 57 - DNA, 1878 bp, Artificial Sequence
  Description of Artificial Sequence: Synthetic polynucleotide
gccgagaacctgtgggtgaccgtgtactatggcgtgccagtgtggaaggacgccgagaccacactgttctgcgcctctgatgccaaggcctacgagacagagaagcacaacgtgtgggcaacccacgcatgcgtgccaacagacccaaacccccaggagatccacctggagaatgtgaccgaggagtttaacatgtggaagaacaatatggtggagcagatgcacgaggacatcatcagcctgtgggatcagtccctgaagccctgcgtgaagctgacccctctgtgcgtgaccctgcagtgtacaaatgccgccctgaccaacgtgaccatcacaaatggccccaacatcacagaggagatcaggaattgttccttcaacatgaccacagagctgcgcgacaagaagcagaaggtgtactctctgttttataagctggatctggtgcagatcaatggcagcggcggcgagtaccggctgatcaattgcaacaccagcgccatcacacaggcctgtcctaaggtgtccttcgagcctatcccaatccactattgcgccccagccggcttcgccatcctgaagtgtaaggacaagaagtttaacggcaccggcccatgcccttccgtgtctaccgtgcagtgtacacacggcatcaagcctgtggtgtccacacagctgctgctgaatggctctctggccgaggaggaagtgatcatcaggagcgagaacatcaccaacaatgccaagaatatcctggtgcagctgaacacaccagtgcagatcaattgcacccggcccaacaataacacagtgaagtctatcagaatcggcccaggccaggccttttactataccggcgacatcatcggcgacatccgccaggcccactgtaatgtgagcggcaccaagtggaacgagacactgaagcaggtggccggcaagctgaggaagcacttcggcaataacaccatcatccgctttgcacagagcagcggaggcgatctggaggtgaccacacactccttcaattgcggcggcgagttcttttactgtaacacatctggcctgtttaatagcacctggcccgagaacggcacaatggagggctctaatggcaccatcacactgccttgccggatcaagcagatcatcaacatgtggcagagaatcggccaggccatgtatgcaccacctatccagggcgtgatcagatgcgtgagcaatatcaccggcctgatcctgacaagagacggcggcaactccaccacagataccgagacattccggcccggcggaggcgacatgagggataactggagaagcgagctgtacaagtataaggtggtgaagatcgagcctctgggcgtggccccaaccagatgcaagaggagagtggtgggcaggcgccggagaaggcgcgcagtgggcatcggagccgtgtccctgggctttctgggagcagcaggcagcacaatgggcgcagcctccatgaccctgacagtgcaggccaggaatctgctgtctggcatcgtgcagcagcagagcaacctgctgcgcgccccagagccacagcagcacctgctgaaggacacccactggggcatcaagcagctgcaggccagggtgctggcagtggagcactacctgagggatcagcagctgctgggcatctggggatgctccggcaagctgatctgctgtaccaatgtgccttggaactctagctggtccaataggaacctgtctgagatctgggacaatatgacctggctgcagtgggataaggagatctccaactacacacagatcatctatggcctgctggaggagtctcagaatcagcaggagaagaacgagcaggacctgctggccctggat

SEQ ID NO: 58 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCCKLTPLCVTLQCTDWDNATLANMTGEIKNCSFNMTTELRDKKQKVYSLFYELDIIPIENEYISNNNTSNTSYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGCAFYATGDIIGDIRQAHCNVSATQWEQTLKGIAAKLLEHFGNNTIIRFANSSGGDLEVTTHSFNCGGEFFYCNTSGLFNGSSWNLNKTKENTTNLENGTITLPCRIKQIINMWQRIGQAMYAPPIQGVIRCVSNITGLILTRDGGNKSAGIETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 59 - DNA, 1902 bp, Artificial Sequence
  Description of Artificial Sequence: Synthetic polynucleotide
gctgaaaatctgtgggtcactgtgtattatggggtgcctgtgtggaaagacgctgagactactctgttctgtgcctccgacgctaaagcctacgaaaccgagaagcacaacgtgtgggcaacccatgcctgcgtccctacagacccaaatccccaggaaatccacctggagaatgtgacagaggagttcaacatgtggaaaaacaatatggtggagcagatgcatactgacatcattagcctgtgggatcagtccctgaagccttgctgcaaactgaccccactgtgcgtcaccctgcagtgtacagactgggataatgctaccctggcaaacatgacaggcgaaatcaagaattgtagtttcaacatgaccacagagctgagggacaagaaacagaaagtgtactccctgttttatgaactggacatcattcccatcgaaaacgagtacatctctaacaacaacacaagtaacacttcatatcgcctgatcaactgcaatactagcgccattacccaggcttgtccaaaggtgtcctttgagcctatcccaattcattactgcgcccccgctggcttcgccatcctgaagtgtaaagataagaagttcaacggcaccgggccatgcccttccgtgtctacagtccagtgtactcacggaattaagccagtggtcagtacacagctgctgctgaacggctcactggcagaggaagaagtgatgatccggagcgagaacatcacaaacaacgctaagaacatcctggtgcagttcaacactcccgtccagattaattgcactagacctaacaacaacacccggaaaagcatcagaattggacccggctgcgccttttatgctaccggcgacatcattggcgacatccggcaggcccactgtaacgtgagcgctactcagtgggaacagaccctgaaggggattgccgctaaactgctggagcatttcggaaacaataccatcattagatttgccaacagctccggcggggacctggaagtgactacccactctttcaattgcggaggcgagttcttttactgtaacactagtggactgtttaatggctctagttggaacctgaataagaccaaagaaaacacaactaatctggagaacggcaccatcacactgccctgccgaattaagcagatcattaacatgtggcagcggatcggccaggcaatgtatgccccccctatccagggcgtgatcagatgtgtctccaacatcacaggactgattctgactagggatgggggaaacaagtctgccgggatcgagactttcaggcctggcgggggagacatgagggataactggcgctccgaactgtacaagtataaagtggtcaagatcgagccactgggagtggctccaacacgatgcaaacgaagagtggtcggaaggcgacgacgaagaagggctgtgggaatcggagcagtcttcctgggctttctgggggcagccggatcaacaatgggcgctgcaagcatgactctgaccgtgcaggcacgaaacctgctgtccggaatcgtccagcagcagtctaatctgctgcgagctcctgaagcacagcagcatctgctgaagctgacagtgtggggcatcaagcagctgcaggcacgggtgctggcagtcgagcgctatctgcgagaccagcagctgctgggcatctgggggtgttctggaaagctgatttgctgtaccaatgtgccctggaacagcagctggtctaacaggaatctgagtgaaatctgggacaacatgacctggctgcagtgggataaggagatttcaaattacacacagatcatctacggcctgctggaagagagccagaatcagcaggagaagaacgagcaggacctgctggccctggat

SEQ ID NO: 60 - protein, 653 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCCKLTPLCVTLQCSDYEGNTTRQNITMKEEKGEIKNCSFNMTTELRDKKQKVYSLFYKLDITPIEEDNNSNNSSSANSSNSNANYTNYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGCAFYATGDIIGDIRQAHCNVSGTKWKNTLKQIVKKLGDHFGNNTIIRFANSSGGDLEVTTHSFNCGGEFFYCNTSGLFNSTWNRTNGTWNDVEGLNYTNGNDTITLPCRIKQIINMWQRIGQAMYAPPIQGVIRCVSNITGLILTRDGGNDTDKNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 61 - DNA, 1959 bp, Artificial Sequence
  Description of Artificial Sequence: Synthetic polynucleotide
gccgaaaatctgtgggtcactgtgtattatggggtccctgtgtggaaggatgccgaaactactctgttctgtgcctccgacgccaaagcctacgaaaccgagaagcacaatgtgtgggccacccatgcttgcgtccctacagacccaaacccccaggaaatccacctggagaacgtgacagaggagttcaacatgtggaaaaacaatatggtcgaacagatgcatactgacatcatttccctgtgggatcagtctctgaagccttgctgcaaactgacaccactgtgcgtcactctgcagtgttccgactatgagggcaacaccacacggcagaatatcaccatgaaggaggaaaaaggggaaattaagaactgttcattcaatatgactaccgagctgagagataagaaacagaaggtgtacagcctgttttataaactggacatcactcccattgaggaagataacaatagcaacaatagctcctctgcaaatagttcaaattccaacgccaattacaccaactataggctgatcaactgcaataccagtgcaattacacaggcctgtccaaaggtgtcatttgagcctatcccaattcattactgcgctcccgcaggcttcgccatcctgaagtgtaaagataagaagttcaacggcaccgggccatgcccttcagtgagcactgtccagtgtacccacgggatcaagccagtggtctccacacagctgctgctgaatggatctctggctgaggaagaagtgatgatcaggagcgagaacattaccaacaatgcaaagaacatcctggtgcagttcaatacacccgtccagattaactgcactcgccctaacaataacacccggaaatccatcagaattggacccggctgcgcattttatgccaccggcgacatcattggcgacatcaggcaggcccactgtaatgtgtctggcaccaagtggaaaaacacactgaagcagattgtgaagaaactgggagaccatttcggcaataacacaatcattcgctttgctaatagctccggcggggatctggaagtgacaactcacagcttcaactgcggaggcgagttcttttactgtaatacaagtggcctgtttaactcaacttggaaccgcacaaatgggacttggaatgacgtggaggggctgaactataccaacggaaatgataccatcacactgccctgccgaattaagcagatcattaatatgtggcagcggatcggccaggctatgtacgcaccccctatccagggcgtgatcagatgtgtcagtaacatcactggactgattctgaccagggacgggggaaacgacacagataaaaatgagactttccggcctggcgggggagacatgagggataactggcgctctgaactgtacaagtataaagtggtcaagatcgagccactgggagtggcccccacaagatgcaaacgaagagtggtcggaaggcgacgacgaagaagggcagtggggatcggagctgtcttcctgggctttctgggggccgctggatctactatgggagcagccagtatgactctgaccgtgcaggctcgcaatctgctgtcagggatcgtccagcagcagagcaacctgctgcgagcccctgaagctcagcagcatctgctgaagctgaccgtgtggggcatcaagcagctgcaggctcgggtgctggcagtcgagcgctacctgcgagatcagcagctgctgggcatctgggggtgtagcggaaagctgatttgctgtacaaacgtgccctggaacagcagctggagcaacagaaatctgtccgaaatctgggacaatatgacttggctgcagtgggataaggagatttctaactacacccagatcatctacggcctgctggaagagagtcagaaccagcaggagaagaacgagcaggacctgctggccctggat

SEQ ID NO: 62 - protein, 661 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCCKLTPLCVTLQCVTLKNCSNSNCSISRNISIEMDGEIKNCSFNMTTELRDKKQKVYSLFYRLDIVPIESSNNSQLSNNSQVSNNSQSSNYSQYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGCAFYATGDIIGDIRQAHCNVSKKDWEKTLQQVATKLGQHFGNNTIIRFANSSGGDLEVTTHSFNCGGEFFYCNTSGLFNSTWIRNSSNSTWNSSASNSTELNSNITLPCRIKQIINMWQRIGQAMYAPPIQGVIRCVSNITGLILTRDGGHETENKTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 63 - DNA, 1983 bp, Artificial Sequence
  Description of Artificial Sequence: Synthetic polynucleotide
gccgaaaatctgtgggtcactgtgtattatggcgtgcccgtgtggaaggatgccgaaactactctgttctgtgcctccgatgctaaagcctacgaaaccgagaagcacaacgtgtgggccactcatgcttgcgtccctaccgacccaaatccccaggaaatccacctggagaatgtgacagaggagttcaacatgtggaaaaacaatatggtcgagcagatgcatactgacatcattagcctgtgggatcagtccctgaagccttgctgcaaactgaccccactgtgcgtgacactgcagtgtgtcactctgaagaactgctctaatagtaactgttcaatcagcaggaatatcagcattgaaatggatggcgagattaagaattgttccttcaacatgaccacagaactgagagacaagaaacagaaagtgtactccctgttctaccggctggacatcgtccccattgagagctccaacaatagccagctgtccaacaattctcaggtgagtaacaattcacagtctagtaactactctcagtatcgcctgatcaattgcaacactagtgcaattacccaggcctgtccaaaggtgtcatttgagcctatcccaattcattactgcgctcccgcaggcttcgccatcctgaagtgtaaagacaagaagttcaacggcaccgggccatgcccttccgtgtctacagtccagtgtactcacggcattaagccagtggtcagcacacagctgctgctgaacgggtccctggcagaggaagaagtgatgatcaggtctgagaatattaccaacaatgccaagaatatcctggtgcagttcaacacacccgtccagattaattgcacacgccctaacaataacactcggaaatctatcagaattggacccggctgcgcattttatgccacaggcgacatcattggcgacatcaggcaggcccactgtaacgtgagcaagaaagactgggagaagaccctgcagcaggtggctacaaaactgggacagcatttcggcaataacaccatcattcgctttgcaaactcaagcggcggggatctggaagtgactacccacagcttcaattgcggaggcgagttcttttactgtaacacttctggcctgtttaatagtacctggatcagaaacagcagcaacagcacctggaatagttcagctagtaactcaacagagctgaacagcaacatcactctgccctgccgaattaagcagatcattaacatgtggcagcggatcgggcaggctatgtatgcaccccctatccagggagtgattcgctgtgtcagcaatatcaccggcctgattctgacacgagacgggggacatgaaaccgagaacaaaacagagactttccggcctggcgggggagacatgagggataattggcgctccgaactgtacaagtataaagtggtcaagatcgagccactgggggtggcccccactagatgcaaacggagagtggtcggaaggcgacgacgaagaagggcagtgggaatcggagctgtcttcctgggctttctgggagcagctggcagcacaatgggcgcagcctctatgaccctgacagtgcaggctcggaacctgctgagtggcatcgtccagcagcagtcaaatctgctgagagcccctgaagctcagcagcacctgctgaagctgacagtgtggggcatcaagcagctgcaggctcgggtgctggcagtcgagcgctatctgcgagatcagcagctgctgggcatctgggggtgtagcggaaagctgatttgctgtactaatgtgccctggaacagcagctggtcaaatagaaacctgagcgaaatctgggacaacatgacttggctgcagtgggataaggagatttctaattacacccagatcatctacggcctgctggaagagagtcagaatcagcaggagaagaacgagcaggacctgctggccctggat

SEQ ID NO: 64 - protein, 626 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCCKLTPLCVTLQCTNAALTNVTITNGPNITEEIRNCSFNMTTELRDKKQKVYSLFYKLDLVQINGSGGEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGCAFYATGDIIGDIRQAHCNVSGTKWNETLKQVAGKLRKHFGNNTIIRFANSSGGDLEVTTHSFNCGGEFFYCNTSGLFNSTWPENGTMEGSNGTITLPCRIKQIINMWQRIGQAMYAPPIQGVIRCVSNITGLILTRDGGNSTTDTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 65 - DNA, 1878 bp, Artificial Sequence
  Description of Artificial Sequence: Synthetic polynucleotide
gccgaaaatctgtgggtgactgtctattatggggtccctgtgtggaaggatgccgaaactactctgttctgtgccagcgatgctaaggcctacgaaaccgagaagcacaatgtgtgggcaacccatgcctgcgtccctacagacccaaacccccaggaaatccacctggagaatgtgaccgaggagttcaacatgtggaaaaacaatatggtggaacagatgcatacagacatcatttccctgtgggatcagtctctgaagccttgctgcaaactgaccccactgtgcgtcactctgcagtgtaccaatgccgctctgaccaacgtgaccatcacaaatggcccaaacatcacagaggaaattcgcaattgttctttcaacatgaccacagagctgcgagacaagaaacagaaggtgtacagcctgttttataaactggatctggtccagatcaatgggtccggcggggaatacaggctgatcaattgcaacacaagtgctattactcaggcatgtccaaaggtgtcatttgagcctatcccaattcattattgcgcccccgctggcttcgccatcctgaagtgtaaagacaagaagttcaacggaactggcccctgcccttcagtgagcaccgtccagtgtacacacggcattaagccagtggtctccacccagctgctgctgaatgggtctctggctgaggaagaagtgatgatccggtccgagaacattactaacaatgcaaagaatatcctggtgcagttcaacacccccgtccagattaattgcactagacctaacaataacacccggaaatccatcagaattgggcccggatgcgctttttatgcaaccggggacatcattggcgacatccgccaggcccactgtaatgtgtctggcactaagtggaacgagaccctgaaacaggtggccggcaagctgcgaaaacatttcgggaataacacaatcattcggtttgctaatagctccggaggcgatctggaagtgactacccacagtttcaactgcgggggagagttcttttactgtaacactagtggactgtttaattcaacatggcctgaaaacggcactatggagggcagcaatggcactatcaccctgccatgcagaattaagcagatcattaacatgtggcagaggatcgggcaggccatgtatgctccccctatccagggagtgattcggtgtgtctcaaatatcacaggcctgattctgactagagacggcgggaacagcacaactgatacagagactttcaggcccggaggcggggacatgagggataactggcgcagcgaactgtacaagtataaagtggtcaagatcgagccactgggagtggcaccaacccgatgcaaacgaagagtggtcggaaggcgacgacgaagaagggcagtgggcattggggccgtcttcctggggtttctgggagcagccggctctacaatgggagctgcaagtatgaccctgacagtgcaggctaggaatctgctgtcaggcatcgtccagcagcagagcaacctgctgcgagcaccagaagcacagcagcatctgctgaagctgaccgtgtggggcatcaagcagctgcaggcccgggtgctggctgtcgagcgctacctgcgagatcagcagctgctggggatctggggatgtagcggcaagctgatttgctgtacaaatgtgccttggaactctagttggagcaatagaaacctgtccgaaatctgggacaatatgacatggctgcagtgggataaggagatttctaactacactcagatcatctacggcctgctggaagagagtcagaatcagcaggagaagaacgagcaggacctgctggccctggat

SEQ ID NO: 66 - protein, 641 aa, Artificial Sequence
  Description of Artificial Sequence: Synthetic polypeptide
AVEQTWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFWKLDVVPIEEGKNNNSSFTDYRLISCNTSVITQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIAPNNFTVKGIHIGPGRAFYYMGDIIGDIRQAHCNISRQNWNNTLKQIAEKLREQFGNKTIVFRQSSGGDPEIVMHTFNCAGMFFYCNTAELFNSTWYANGTISIGGGNKTNIILPCRIKLFINMWQEVGKAMYAPPISGQIRCSSNITGLLLTRDGGRGNQTDNQTEIFRPVGGDMKNNWRSELYKYKVVRIEPLGIAPTRCKRRVVGRRRRRRAVGIGALSLGFLGAAGSTMGAASMTLTVQARLLLSGIVQQQNNLLRAPEPQQHLLQDTHWGIKQLQARVLAVEHYLRDQQLLGIWGCSGKLICCTAVPWNVSWNNRSVDDIWENMTWMQWDREISNYTSLIYTLIEESQNQQEKNEQELLALD

SEQ ID NO: 67 - DNA, 1923 bp, Artificial Sequence
  Description of Artificial Sequence: Synthetic polynucleotide
gccgtggagcagacctgggtgacagtgtactatggcgtgcccgtgtggaaggaggccaacaccacactgttctgcgccagcgacgccaaggcctacaacaccgaggtgcacaacgtgtgggcaacccacgcatgcgtgcctacagatccaaatccccaggaggtggagctggagaacgtgacagagaacttcaacatgtggaagaacaatatggtggaccagatgcacgaggacatcatctctctgtgggaccagagcctgaagccttgcgtgaagctgaccccactgtgcgtgaccctgtcttgtacagacaatgtgggcaacgataccagcacaaacaattccagatgggataagatggagaagggcgagatcaagaattgtagcttcaacatcaccacaaatatgagggacaagatgcagaagcagtacgccctgttttggaagctggatgtggtgcccatcgaggagggcaagaacaataacagctccttcaccgactatagactgatctcttgcaataccagcgtgatcacacaggcctgtccaaaggtgacatttgagcctatcccaatccactactgcgcaccagcaggattcgcactgctgaagtgtaaggataagaagtttaatggcaccggcccttgcaagaacgtgtccaccgtgcagtgtacacacggcatcaagccagtggtgtctacacagctgctgctgaacggcagcctggccgaggaggaggtggtcatccggtccgagaatttctctaataacgccagaaccatcatcgtgcagctgaacacatccgtggagatcaagtgcatcgcccccaataacttcaccgtgaagggcatccacatcggccctggcagggccttttactatatgggcgacatcatcggcgacatcaggcaggcccactgtaacatctctcgccagaattggaataacaccctgaagcagatcgccgagaagctgcgcgagcagttcggcaataagacaatcgtgtttcggcagtctagcggcggcgacccagagatcgtgatgcacaccttcaactgcgccggcatgttcttttactgtaacacagccgagctgtttaattccacctggtatgccaacggcacaatctctatcggcggcggcaataagaccaacatcatcctgccctgccgcatcaagctgttcatcaatatgtggcaggaagtgggcaaggcaatgtacgcaccacctatcagcggacagatcaggtgttcctctaacatcaccggcctgctgctgacacgggacggcggcagaggaaaccagaccgataatcagacagagatctttagacctgtgggcggcgatatgaagaataactggcggtccgagctgtacaagtataaggtggtgagaatcgagccactgggaatcgcaccaaccaggtgcaagaggagagtggtgggcaggcgccggagaaggcgcgcagtgggcatcggcgccctgagcctgggctttctgggagcagcaggcagcacaatgggcgcagcctccatgaccctgacagtgcaggccagactgctgctgtccggcatcgtgcagcagcagaataacctgctgagggcccccgagcctcagcagcacctgctgcaggacacccactggggcatcaagcagctgcaggccagggtgctggcagtggagcactatctgcgcgatcagcagctgctgggcatctggggctgctctggcaagctgatctgctgtaccgccgtgccctggaacgtgtcctggaataaccgctctgtggacgacatctgggagaatatgacatggatgcagtgggaccgggagatcagcaactacacctccctgatctatacactgatcgaggagtcccagaaccagcaggagaagaatgagcaggagctgctggccctggat

SEQ ID NO: 68 - protein, 635 aa, Artificial Sequence
  Description of Artificial Sequence: Synthetic polypeptide
AENLWVTVYYGVPVWKDAETTLFCASDAKAYSTEKHNVWATHACVPTDPNPQEVVLENVTENFNMWKNNMVEQMHEDIISLWDQSLKPCVKLTPLCVTLNCTELNDTNTTATNSSGRVIEDKEIKNCSFNMTTSLRDKVQRVYSLFNKFDIVPIDNSNDSYRLISCNTSAITQACPKVSFEPIPIHYCAPAGFAILKCNDKEFNGTGPCKSVSTVQCTHGIRPVVSTQLLLNGSLAEEEVIIRSENFTNNAKTILVQLNEPVVINCTRPNNNTVKSIRIGPGQAFYYTGEIIGDIRQAHCTVSRETWNKTLGRVVEQLREQFRNKTIIVFNQSSGGDPEIVMHSFNCGGEFFYCNSTQLFNSTWYGNETETGGTNDTIGNITLPCRIKQIINMWQEVGKAMYAPPIRGQISCSSNITGLILTRDGGNNNETNTTETFRPGGGDMRDNWRSELYKYKVVKIEPLGVAPTKCKRRVVGRRRRRRAVGIGAMSLGFLGAAGSTMGAASLTLTVQARNLLSGIVQQQSNLLRAPEPQQHLLKDTHWGIKQLQARVLAVEHYLRDQQLLGIWGCSGKLICCTNVPWNTSWSNKSLDQIWDNMTWLEWDREISNYTQLIYNLLEESQNQQEKNEQDLLALD

SEQ ID NO: 69 - DNA, 1905 bp, Artificial Sequence
  Description of Artificial Sequence: Synthetic polynucleotide
gccgagaatctgtgggtgaccgtgtactatggcgtgcccgtgtggaaggacgcagagaccacactgttctgcgcctccgatgccaaggcctactctacagagaagcacaacgtgtgggcaacccacgcatgcgtgcctacagacccaaatccccaggaggtggtgctggagaacgtgaccgagaactttaatatgtggaagaacaatatggtggagcagatgcacgaggacatcatctctctgtgggatcagagcctgaagccttgcgtgaagctgaccccactgtgcgtgaccctgaattgtacagagctgaacgacaccaataccacagccacaaacagctccggcagagtgatcgaggataaggagatcaagaactgtagcttcaatatgaccacatccctgcgggacaaggtgcagagagtgtactccctgttcaataagtttgatatcgtgcctatcgacaactccaatgattcttatagactgatcagctgcaacacctccgccatcacacaggcctgtccaaaggtgtcttttgagcctatcccaatccactactgcgcaccagcaggattcgcaatcctgaagtgtaacgacaaggagtttaatggcaccggcccttgcaagagcgtgtccaccgtgcagtgtacacacggcatccggccagtggtgtctacacagctgctgctgaatggcagcctggccgaggaggaagtgatcatcagaagcgagaacttcaccaacaatgccaagacaatcctggtgcagctgaacgagcccgtggtcatcaactgcaccaggcctaacaataacacagtgaagtctatccgcatcggcccaggccaggccttttactataccggcgagatcatcggcgatatcaggcaggcccactgtacagtgagccgcgagacctggaacaagacactgggaagggtggtggagcagctgagggagcagttcagaaataagaccatcatcgtgtttaaccagtctagcggcggcgacccagagatcgtgatgcactccttcaactgcggcggcgagttcttttactgtaactctacccagctgtttaatagcacatggtatggcaacgagaccgagacaggcggcaccaacgatacaatcggcaatatcaccctgccctgcaggatcaagcagatcatcaatatgtggcaggaagtgggcaaggcaatgtacgcaccacctatcaggggacagatcagctgttcctctaacatcaccggcctgatcctgacaagggacggaggcaataacaatgagaccaataccacagagacattcagacccggcggcggcgacatgagggataactggcgctccgagctgtacaagtataaggtggtgaagatcgagccactgggagtggcaccaaccaagtgcaagaggagagtggtgggcaggcgccggagaaggcgcgcagtgggcatcggcgccatgagcctgggctttctgggagcagcaggatccacaatgggagcagcctctctgaccctgacagtgcaggccaggaatctgctgagcggcatcgtgcagcagcagtccaacctgctgagggcaccagagcctcagcagcacctgctgaaggacacccactggggcatcaagcagctgcaggcacgggtgctggcagtggagcactatctgagagatcagcagctgctgggaatctggggatgcagcggcaagctgatctgctgtaccaacgtgccttggaatacatcttggagcaataagtccctggaccagatctgggataacatgacctggctggagtgggatagagagatctccaattacacacagctgatctataacctgctggaggagtctcagaaccagcaggagaagaatgagcaggacctgctggccctggat

SEQ ID NO: 70 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 71 - DNA, 1902 bp, Artificial Sequence
  Description of Artificial Sequence: Synthetic polynucleotide
gccgagaacctgtgggtgaccgtgtactatggcgtgcccgtgtggaaggacgcagagaccacactgttctgcgccagcgatgccaaggcctacgagacagagaagcacaacgtgtgggcaacccacgcatgcgtgcctacagacccaaacccccaggagatccacctggagaatgtgaccgaggagtttaacatgtggaagaacaatatggtggagcagatgcacgaggacatcatctctctgtgggatcagagcctgaagccttgcgtgaagctgaccccactgtgcgtgacactgcagtgtaccaacgtgacaaacaatatcaccgacgatatgaggggcgagctgaagaattgttctttcaacatgaccacagagctgcgggacaagaagcagaaagtgtacagcctgttttatagactggatgtggtgcagatcaatgagaaccagggcaataggagcaacaattccaacaaggagtaccgcctgatcaattgcaacacctctgccatcacacaggcctgtcctaaggtgagcttcgagcctatcccaatccactattgcgcaccagcaggattcgcaatcctgaagtgtaaggataagaagtttaatggcaccggcccttgccagaacgtgtccaccgtgcagtgtacacacggcatcaagccagtggtgagcacacagctgctgctgaatggctccctggccgaggaggaagtgatcatccggtctgagaacatcaccaacaatgccaagaatatcctggtgcagctgaacacaagcgtgcagatcaattgcaccaggcccaacaataacacagtgaagtccatccgcatcggccctggccaggccttttactataccggcgacatcatcggcgacatcagacaggcccactgtaacgtgagcaaggccacctggaacgagacactgggcaaggtggtgaagcagctgcggaagcacttcggcaataacaccatcatcagatttgcacagagcagcggaggcgacctggaggtgaccacacactccttcaattgcggcggcgagttcttttactgtaacacatccggcctgtttaattctacctggatctctaacacaagcgtgcagggctccaattctaccggctccaacgattctatcacactgccatgcaggatcaagcagatcatcaacatgtggcagaggatcggacaggcaatgtatgcaccacctatccagggcgtgatcagatgcgtgagcaatatcaccggcctgatcctgacacgcgacggaggcagcaccaactccaccacagagacattcaggcccggcggaggcgacatgagggataactggagatccgagctgtacaagtataaggtggtgaagatcgagccactgggagtggcaccaaccaggtgcaagaggagagtggtgggcaggcgccggagaaggcgcgcagtgggcatcggagccgtgagcctgggctttctgggagcagcaggctctacaatgggcgcagccagcatgaccctgacagtgcaggcccggaatctgctgtccggcatcgtgcagcagcagtctaacctgctgagagcccccgagcctcagcagcacctgctgaaggacacccactggggcatcaagcagctgcaggccagagtgctggccgtggagcactacctgagagatcagcagctgctgggcatctggggatgctccggcaagctgatctgctgtaccaatgtgccttggaactctagctggagcaatagaaacctgtccgagatctgggacaatatgacctggctgcagtgggataaggagatctccaactacacacagatcatctatggcctgctggaggagtctcagaatcagcaggagaagaacgagcaggacctgctggccctggat

SEQ ID NO: 72 - protein, 644 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDGTKHHHHHHC

SEQ ID NO: 73 - DNA, 1932 bp, Artificial Sequence
  Description of Artificial Sequence: Synthetic polynucleotide
gccgaaaatctgtgggtgactgtctactatggcgtgcctgtctggaaggacgccgagaccacactgttctgtgcttccgatgctaaggcatacgaaaccgagaaacacaacgtgtgggcaacccatgcctgcgtcccaacagacccaaacccccaggaaatccacctggagaatgtgaccgaggagttcaacatgtggaagaacaatatggtggaacagatgcatgaggacatcatttccctgtgggatcagtctctgaagccttgcgtgaaactgaccccactgtgcgtgacactgcagtgtacaaacgtcactaacaatatcaccgacgatatgcggggcgaactgaagaattgttctttcaacatgactaccgagctgagggacaagaaacagaaagtgtacagtctgttttatcgcctggatgtggtccagatcaatgaaaaccaggggaatcgaagtaacaattcaaacaaggagtaccggctgattaattgcaacaccagtgccatcacacaggcttgtccaaaagtgtcattcgagcctatcccaattcattattgcgcccccgctggcttcgccatcctgaagtgtaaagataagaagttcaacggcaccgggccatgcccttcagtgagcactgtccagtgtacccacggaattaagcctgtggtctccacacagctgctgctgaatggctctctggctgaggaagaagtgatcattaggtctgagaacatcactaacaatgcaaagaatattctggtgcagctgaacacccccgtccagatcaattgcactcgccctaacaataacaccgtgaaatctatccgaattggacccggccaggctttttattacaccggcgacatcattggcgacatcagacaggcacactgcaatgtgagcaaggccacatggaacgagactctggggaaggtggtcaaacagctgcgcaaacatttcggaaataacacaatcattcgatttgcacagagcagcggaggggacctggaagtgacaactcacagcttcaattgcggaggcgagttcttttactgtaacactagtggcctgtttaattcaacttggatcagcaacacctccgtgcagggcagcaacagcaccggctctaacgatagtatcacactgccatgtcggattaagcagatcattaacatgtggcagagaatcgggcaggccatgtatgcaccccctatccagggagtgattcgatgcgtgagcaatatcacaggcctgattctgactagagacgggggatcaacaaacagcaccacagagactttccggcccggcggaggagacatgcgagataactggagatccgaactgtacaagtataaagtggtcaagatcgagccactgggcgtggctcccaccagatgcaaacgaagagtggtcgggaggcgccgacggagaagggctgtggggattggagcagtcagcctgggctttctgggggccgctggatctacaatgggggcagccagtatgactctgaccgtgcaggccaggaatctgctgtcaggaatcgtgcagcagcagagcaacctgctgagggctcccgaaccccagcagcacctgctgaaggacacccactggggcatcaagcagctgcaggcaagagtgctggccgtcgagcattacctgagggatcagcagctgctgggcatctggggatgcagcggaaagctgatttgctgtacaaatgtgccttggaactctagttggagcaatcgcaacctgtccgaaatctgggacaatatgacatggctgcagtgggataaggagattagcaactacactcagatcatctacggcctgctggaagagtcccagaatcagcaggagaagaacgagcaggacctgctggccctggatggtaccaagcaccaccatcaccatcactgt

SEQ ID NO: 74 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGTDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 75 - DNA, 1902 bp, Artificial Sequence
  Description of Artificial Sequence: Synthetic polynucleotide
gccgaaaatctgtgggtgactgtctactatggcgtgcctgtctggaaggacgccgagaccacactgttctgtgcttccgatgctaaggcatacgaaaccgagaaacacaacgtgtgggcaacccatgcctgcgtcccaacagacccaaacccccaggaaatccacctggagaatgtgaccgaggagttcaacatgtggaagaacaatatggtggaacagatgcatgaggacatcatttccctgtgggatcagtctctgaagccttgcgtgaaactgaccccactgtgcgtgacactgcagtgtacaaacgtcactaacaatatcaccgacgatatgcggggcgaactgaagaattgttctttcaacatgactaccgagctgagggacaagaaacagaaagtgtacagtctgttttatcgcctggatgtggtccagatcaatgaaaaccaggggaatcgaagtaacaattcaaacaaggagtaccggctgattaattgcaacaccagtgccatcacacaggcttgtccaaaagtgtcattcgagcctatcccaattcattattgcgcccccgctggcttcgccatcctgaagtgtaaagataagaagttcaacggcaccgggccatgcccttcagtgagcactgtccagtgtacccacggaattaagcctgtggtctccacacagctgctgctgaatggctctctggctgaggaagaagtgatcattaggtctgagaacatcactaacaatgcaaagaatattctggtgcagctgaacacccccgtccagatcaattgcactcgccctaacaataacaccgtgaaatctatccgaattggacccggccaggctttttattacaccggcgacatcattggcgacatcagacaggcacactgcaatgtgagcaaggccacatggaacgagactctggggaaggtggtcaaacagctgcgcaaacatttcggaaataacacaatcattcgatttgcacagagcagcggaggggacctggaagtgacaactcacagcttcaattgcggaggcgagttcttttactgtaacactagtggcctgtttaattcaacttggatcagcaacacctccgtgcagggcagcaacagcaccggctctaacgatagtatcacactgccatgtcggattaagcagatcattaacatgtggcagagaatcgggcaggccatgtatgcaccccctatccagggagtgattcgatgcgtgagcaatatcacaggcctgattctgactagagacgggggatcaacaaacagcaccacagagactttccggcccggcggaaccgacatgcgagataactggagatccgaactgtacaagtataaagtggtcaagatcgagccactgggcgtggctcccaccagatgcaaacgaagagtggtcgggaggcgccgacggagaagggctgtggggattggagcagtcagcctgggctttctgggggccgctggatctacaatgggggcagccagtatgactctgaccgtgcaggccaggaatctgctgtcaggaatcgtgcagcagcagagcaacctgctgagggctcccgaaccccagcagcacctgctgaaggacacccactggggcatcaagcagctgcaggcaagagtgctggccgtcgagcattacctgagggatcagcagctgctgggcatctggggatgcagcggaaagctgatttgctgtacaaatgtgccttggaactctagttggagcaatcgcaacctgtccgaaatctgggacaatatgacatggctgcagtgggataaggagattagcaactacactcagatcatctacggcctgctggaagagtcccagaatcagcaggagaagaacgagcaggacctgctggccctggat

SEQ ID NO: 76 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFWRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTAPNNFTVKSIRIGPGQAFYYMGDIIGDIRQAHCNVSKATWNETLGKVVKQLRKHFGNNTIIRFAQSSGGDLEVTTHSFNCGGMFFYCNTSGLFNSTWISNTSVQGSNSTGSNDSITLPCRIKLIINMWQRIGQAMYAPPIQGVIRCVSNITGLILTRDGGSTNSTTETFRPGGTDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 77 - DNA, 1902 bp, Artificial Sequence
  Description of Artificial Sequence: Synthetic polynucleotide
gccgaaaacctgtgggtgactgtctactatggcgtgcccgtctggaaggacgcagagaccacactgttctgcgctagcgatgctaaggcctacgagaccgagaaacacaacgtgtgggcaacccatgcctgcgtgcctacagacccaaatccccaggaaatccacctggagaacgtgaccgaggagttcaacatgtggaagaacaatatggtggaacagatgcatgaggacatcatttccctgtgggatcagtctctgaagccctgcgtgaaactgacccctctgtgcgtcacactgcagtgtacaaacgtgactaacaatatcaccgacgatatgcggggcgaactgaagaactgttctttcaatatgactaccgagctgcgcgacaagaaacagaaagtgtacagtctgttttggcgactggatgtggtccagatcaacgaaaatcaggggaaccggagtaacaactcaaataaggagtatagactgatcaactgcaataccagtgccattacacaggcttgtcctaaagtgtcattcgagcctatcccaattcattactgcgccccagctggcttcgccatcctgaagtgtaaagataagaagttcaacggcaccgggccatgcccttcagtgagcactgtccagtgtacccacggaattaagcctgtggtctccacacagctgctgctgaacggctctctggctgaggaagaagtgatcattagatccgagaatatcactaacaatgcaaagaacattctggtgcagctgaataccccagtccagatcaactgcactgcccccaacaatttcaccgtgaaatctatccggattggaccaggccaggctttttactatatgggcgacatcattggggatattagacaggcacactgtaacgtgagcaaggccacatggaatgaaactctggggaaggtggtcaaacagctgcgaaaacatttcggaaacaatacaatcattcgatttgcacagagcagcggaggggacctggaggtgacaactcacagcttcaactgcggaggcatgttcttttattgtaatactagtggcctgtttaactcaacttggatcagcaatacctccgtgcagggcagcaacagcaccggctctaatgatagtatcacactgccatgcagaattaagctgatcattaatatgtggcagaggatcgggcaggctatgtacgcaccccctatccagggagtgattcggtgcgtgagcaacatcacaggcctgattctgactagagacgggggatcaacaaatagcaccacagagactttcaggcccggcggaaccgacatgcgagataactggcgatccgaactgtacaagtataaagtggtcaagatcgagcctctgggagtggcaccaacccgatgcaaacgaagagtggtcgggaggcgccgacggagaagggctgtggggattggagcagtctctctgggctttctgggggccgctggatctacaatgggggcagccagtatgactctgaccgtccaggcaaggaacctgctgtcaggaatcgtgcagcagcagagcaatctgctgcgcgctccagaaccccagcagcacctgctgaaggacacccattggggcatcaagcagctgcaggcaagggtgctggcagtcgagcactacctgcgagatcagcagctgctgggcatctggggatgcagcggaaagctgatttgctgtacaaacgtgccctggaacagcagctggagcaaccggaatctgtccgaaatctgggacaacatgacatggctgcagtgggataaggagattagcaattacactcagatcatctacggcctgctggaagagtcccagaaccagcaggagaagaacgagcaggacctgctggccctggat

SEQ ID NO: 78 - protein, 641 aa, Artificial Sequence
  Description of Artificial Sequence: Synthetic polypeptide
AVEQTWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFWKLDVVPIEEGKNNNSSFTDYRLISCNTSVITQACPKVTFEPIPIHYCAPAGFALLKCKDKKFNGTGPCKNVSTVQCTHGIKPVVSTQLLLNGSLAEEEVVIRSENFSNNARTIIVQLNTSVEINCTAPNNFTVKGIHIGPGRAFYYMGDIIGDIRQAHCNISRQNWNNTLKQIAEKLREQFGNKTIVFRQSSGGDPEIVMHTFNCAGMFFYCNTSELFNSTWYANGTISIGGGNKTNIILPCRIKLFINMWQEVGKAMYAPPISGQIRCSSNITGLLLTRDGGRGNQTDNQTEIFRPVGGDMKNNWRSELYKYKVVRIEPLGIAPTRCKRRVVGRRRRRRAVGIGALSLGFLGAAGSTMGAASMTLTVQARLLLSGIVQQQNNLLRAPEPQQHLLQDTHWGIKQLQARVLAVEHYLRDQQLLGIWGCSGKLICCTAVPWNVSWNNRSVDDIWENMTWMQWDREISNYTSLIYTLIEESQNQQEKNEQELLALD

SEQ ID NO: 79 - DNA, 1923 bp, Artificial Sequence
  Description of Artificial Sequence: Synthetic polynucleotide
gccgtggagcagacctgggtgacagtgtactatggcgtgcccgtgtggaaggaggccaacaccacactgttctgcgccagcgacgccaaggcctacaacaccgaggtgcacaacgtgtgggcaacccacgcatgcgtgcctacagatccaaatccccaggaggtggagctggagaacgtgacagagaacttcaacatgtggaagaacaatatggtggaccagatgcacgaggacatcatctctctgtgggaccagagcctgaagccttgcgtgaagctgaccccactgtgcgtgaccctgtcttgtacagacaatgtgggcaacgataccagcacaaacaattccagatgggataagatggagaagggcgagatcaagaattgtagcttcaacatcaccacaaatatgagggacaagatgcagaagcagtacgccctgttttggaagctggatgtggtgcccatcgaggagggcaagaacaataacagctccttcaccgactatagactgatctcttgcaataccagcgtgatcacacaggcctgtccaaaggtgacatttgagcctatcccaatccactactgcgcaccagcaggattcgcactgctgaagtgtaaggataagaagtttaatggcaccggcccttgcaagaacgtgtccaccgtgcagtgtacacacggcatcaagccagtggtgtctacacagctgctgctgaacggcagcctggccgaggaggaggtggtcatccggtccgagaatttctctaataacgccagaaccatcatcgtgcagctgaacacatccgtggagatcaactgcaccgcccccaataacttcaccgtgaagggcatccacatcggccctggcagggccttttactatatgggcgacatcatcggcgacatcaggcaggcccactgtaacatctctcgccagaattggaataacaccctgaagcagatcgccgagaagctgcgcgagcagttcggcaataagacaatcgtgtttcggcagtctagcggcggcgacccagagatcgtgatgcacaccttcaactgcgccggcatgttcttttactgtaacacaagcgagctgtttaattccacctggtatgccaacggcacaatctctatcggcggcggcaataagaccaacatcatcctgccctgccgcatcaagctgttcatcaatatgtggcaggaagtgggcaaggcaatgtacgcaccacctatcagcggacagatcaggtgttcctctaacatcaccggcctgctgctgacacgggacggcggcagaggaaaccagaccgataatcagacagagatctttagacctgtgggcggcgatatgaagaataactggcggtccgagctgtacaagtataaggtggtgagaatcgagccactgggaatcgcaccaaccaggtgcaagaggagagtggtgggcaggcgccggagaaggcgcgcagtgggcatcggcgccctgagcctgggctttctgggagcagcaggcagcacaatgggcgcagcctccatgaccctgacagtgcaggccagactgctgctgtccggcatcgtgcagcagcagaataacctgctgagggcccccgagcctcagcagcacctgctgcaggacacccactggggcatcaagcagctgcaggccagggtgctggcagtggagcactatctgcgcgatcagcagctgctgggcatctggggctgctctggcaagctgatctgctgtaccgccgtgccctggaacgtgtcctggaataaccgctctgtggacgacatctgggagaatatgacatggatgcagtgggaccgggagatcagcaactacacctccctgatctatacactgatcgaggagtcccagaaccagcaggagaagaatgagcaggagctgctggccctggat

SEQ ID NO: 80 - protein, 630 aa, Artificial Sequence
  Description of Artificial Sequence: Synthetic polypeptide
TENLWVTVYYGVPVWRDAETTLFCASDAKAYDTEMHNVWATHACVPTDPNPQEIDLENVTEKFNMWKNNMVEQMHEDIISLWDQSLKPCVKLTPLCVTLNCTAITNDTRGNETGINRTVETTEMTNCSFNMTTELRDRKKKVNALFYKLDIVQIGENSSSQYRLINCNTSVITQACPKVTFEPIPIHYCAPAGFAILKCKDKEFNGTGTCRNVSSVQCTHGIKPVVSTQLLLNGSLAEGQVIIRSENISDNAKTIIVQLNESVPINCTRPNNNTVRGIHLGPGQTFFYTDIIGDIRQAHCNVSESKWNKALQEVVKQLRQHWNKTIIFKSSSGGDLEITTHSFNCGGEFFYCNTSGLFNSTWNIAGNRTNDTKSNETITLPCRIKQIVNVWQRVGQAIYAPPIAGVIRCNSNITGLLLVRDGGATNNTDETFRPGGGNMRDNWRSELYKYKVVKIEPLGVAPTRCRRRVVERRRRRRAVGLGAVSIGFLGAAGSTMGAASVTLTVQARQLLSGIVQQQSNLLRAPEPQQHLLKDTHWGIKQLQARVLAVEHYLKDQQLLGIWGCSGKLICCTTVPWNSSWSNKSQNEIWDNMTWLQWDKEISNYTQLIYSLIEESQNQQEKNEQELLALD

SEQ ID NO: 81 - protein, 639 aa, Artificial Sequence
  Description of Artificial Sequence: Synthetic polypeptide
VENLWVTVYYGVPVWKEARTTLFCASDAKAYETEVHNVWATHACVPTDPNPQEMVLGNVTENFNMWKNDMVDQMHEDVISLWAQSLKPCVKLTPLCVTLECTQVNATQGNTTQVNVTQVNGDEMKNCSFNTTTEIRDKKQKAYALFYRLDLVPLERENRGDSNSASKYILINCNTSAITQACPKVNFDPIPIHYCTPAGYAILKCNNKTFNGTGSCNNVSTVQCTHGIKPVVSTQLLLNGSLAEEEIIIRSENLTDNVKTIIVHLDQSVEIVCTRPNNNTVKSIRIGPGQTFYYTGDIIGNIREAHCNISEKKWHEMLRRVSEKLAEHFPNKTIKFTSSSGGDLEITTHSFNCRGEFFYCNTSGLFNSTYMPNGTYMPNGTNNSNSTIILPCRIKQIINMWQEVGRAMYAPPIAGNITCNSNITGLLLVRDGGKNNNTEIFRPGGGDMRDNWRSELYKYKVVEIKPLGVAPTRCKRRVVGRRRRRRAVGLGAVSLGFLGAAGSTMGAASITLTVQARQLLSGIVQQQSNLLQAPEPQQHLLQDTHWGIKQLQTRVLAIEHYLKDQQLLGIWGCSGKLICCTAVPWNSSWSNKSLTDIWDNMTWMQWDREVSNYTGIIYRLLEDSQNQQERNEQDLLALD

SEQ ID NO: 82 - protein, 641 aa, Artificial Sequence
  Description of Artificial Sequence: Synthetic polypeptide
AVEQTWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVITQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTVKGIHIGPGRAFYYTGDIIGDIRQAHCNISRQNWNNTLKQIAEKLREQFGNKTIVFRQSSGGDPEIVMHTFNCAGEFFYCNTAELFNSTWYANGTISIGGGNKTNIILPCRIKQFINMWQEVGKAMYAPPISGQIRCSSNITGLLLTRDGGRGNQTDNQTEIFRPVGGDMKNNWRSELYKYKVVRIEPLGIAPTRCKRRVVGRRRRRRAVGIGALSLGFLGAAGSTMGAASMTLTVQARLLLSGIVQQQNNLLRAPEPQQHLLQDTHWGIKQLQARVLAVEHYLRDQQLLGIWGCSGKLICCTAVPWNVSWNNRSVDDIWENMTWMQWDREISNYTSLIYTLIEESQNQQEKNEQELLALD

SEQ ID NO: 83 - protein, 641 aa, Artificial Sequence; identical to SEQ ID NO: 66
  Description of Artificial Sequence: Synthetic polypeptide

SEQ ID NO: 84 - protein, 652 aa, Artificial Sequence
  Description of Artificial Sequence: Synthetic polypeptide
MEQLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKNCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEINCTRPNNNTVKSVRIGPGQTFFYTGEIIGDIRQAHCNLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRAMYASPIAGIITCKSNITGLLLTRDGGNKSAGIETFRPGGGNMKDNWRSELYKYKVVEIKPLGIAPTSCKRRVVERRRRRRAAGIGAVSLGFLGAAGSTMGAASVMLTVQARQLLSGIVQQQSNLLRAPEPQQHMLQDTHWGIKQLQTRVLAIEHYLKDQQLLGLWGCSGKLICCTAVPWNTSWSNKSKDEIWDNMTWMQWDREIDNYTQVIYQLLEVSQNQQEKNENDLLALD

SEQ ID NO: 85 - protein, 642 aa, Artificial Sequence
  Description of Artificial Sequence: Synthetic polypeptide
AAKKWVTVYYGVPVWKEATTTLFCASDAKAYDTEVHNVWATHACVPTDPNPQEIVLGNVTENFNMWKNNMVEQMHEDIISLWDQSLKPCVKLTPLCVTLNCNNVNTNNTNNSTNATISDWEKMETGEMKNCSFNVTTSIRDKIKKEYALFYKLDVVPLENKNNINNTNITNYRLINCNTSVITQACPKVSFEPIPIHYCAPAGFAILKCNSKTFNGSGPCTNVSTVQCTHGIRPVVSTQLLLNGSLAEEEIVIRSENITDNAKTIIVQLNEAVEINCTRPNNNTVKSIHIGPGRAFYYTGDIIGNIRQAHCNISKARWNETLGQIVAKLEEQFPNKTIIFNHSSGGDPEIVTHSFNCGGEFFYCNTTPLFNSTWNNTRTDDYPTGGEQNITLQCRIKQIINMWQGVGKAMYAPPIRGQIRCSSNITGLLLTRDGGRDQNGTETFRPGGGNMRDNWRSELYKYKVVKIEPLGIAPTACKRRVVQRRRRRRAVGLGAFSLGFLGAAGSTMGAASMALTVQARLLLSGIVQQQNNLLRAPEPQQHMLQDTHWGIKQLQARVLAVEHYLRDQQLLGIWGCSGKIICCTNVPWNDSWSNKTINEIWDNMTWMQWEKEIDNYTQHIYTLLEVSQIQQEKNEQELLELD

SEQ ID NO: 86 - protein, 642 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGSHSGSGGSGSGGHAAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 87 - protein, 637 aa, Artificial Sequence
  Description of Artificial Sequence: Synthetic polypeptide
VSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDGGSGSGGGSGSGGSSAENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVG

SEQ ID NO: 88 - protein, 630 aa, Artificial Sequence
  Description of Artificial Sequence: Synthetic polypeptide
VSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLGGSGSGGGSGSGGSSGSGLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRR

SEQ ID NO: 89 - protein, 622 aa, Artificial Sequence
  Description of Artificial Sequence: Synthetic polypeptide
VSLGFLGAAGSTMGAASMTLTVQARNLLSGIVQQQSNLLRAPEPQQHLLKDTHWGIKQLQARVLAVEHYLRDQQLLGIWGCSGKLICCTGGSGVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGGSGSGVPWNSSWSNRNLSEIWDNMTWLQWDKEISNYTQIIYGLLEESQNQQEKNEQDLLALD

SEQ ID NO: 90 - protein, 634 aa, Artificial Sequence
  Description of Artificial Sequence: Synthetic polypeptide
VSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESGGSGSGAGGLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGGSGSGQNQQEKNEQDLLALD

SEQ ID NO: 91 - protein, 637 aa, Artificial Sequence
  Description of Artificial Sequence: Synthetic polypeptide
AENLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNNQSLLALDNGS

SEQ ID NO: 92 - protein, 637 aa, Artificial Sequence
  Description of Artificial Sequence: Synthetic polypeptide
AENLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNANLSEIWDNMTWLQWDKNISNYTQIIYGLLEESQNQQEKNNQSLLALDNGS

SEQ ID NO: 93 - protein, 630 aa, Artificial Sequence
  Description of Artificial Sequence: Synthetic polypeptide
VSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLGGNGSGGGSGSGGNGSSGLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRR

SEQ ID NO: 94 - protein, 645 aa, Artificial Sequence
  Description of Artificial Sequence: Synthetic polypeptide
AENLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGSHSGSGGSGSGGHAAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNNQSLLALDNGS

SEQ ID NO: 95 - protein, 645 aa, Artificial Sequence
  Description of Artificial Sequence: Synthetic polypeptide
AENLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGSHSGSGGSGSGGHAAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNANLSEIWDNMTWLQWDKNISNYTQIIYGLLEESQNQQEKNNQSLLALDNGS

SEQ ID NO: 96 - protein, 617 aa, Artificial Sequence
  Description of Artificial Sequence: Synthetic polypeptide
VSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLGGNGSGGGSGSGGNGSSGLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDNMTGELKNCSFNMTTELRDKKQKVYSLFYRLDVVQINGSGGEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWPENGTMEGSNGTITLPCRIKQIINMWQRIGQAMYAPPIQGVIRCVSNITGLILTRDGGSTNSTTETFRPGGGDMRDNWRSELYKYKVVKIEPLGVAPTRCKRR

SEQ ID NO: 97 - protein, 622 aa, Artificial Sequence
  Description of Artificial Sequence: Synthetic polypeptide
GGNSSGSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQNESNEQDLGGNGSGGGSGSGGNGSSGLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDNMTGELKNCSFNMTTELRDKKQKVYSLFYRLDVVQINGSGGEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWPENGTMEGSNGTITLPCRIKQIINMWQRIGQAMYAPPIQGVIRCVSNITGLILTRDGGSTNSTTETFRPGGGDMRDNWRSELYKYKVVKIEPLGVAPTRCNRS

SEQ ID NO: 98 - protein, 624 aa, Artificial Sequence
  Description of Artificial Sequence: Synthetic polypeptide
AENLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDNMTGELKNCSFNMTTELRDKKQKVYSLFYRLDVVQINGSGGEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWPENGTMEGSNGTITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNNQSLLALDNGS

SEQ ID NO: 99 - protein, 811 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDGSGGLSERMLKALNDQLNRELYSAYLYFAMAAYFEDLGLEGFANWMKAQAEEEIGHALRFYNYIYDKNGRVELDEIPKPPKEWESPLKAFEAAYEHEKFISKSIYELAALAEEEKDYSTRAFLEWFINEQVEEEASVKKILDKLKFAKDSPQILFMLDKELSARAPKLPGLLMQGGE

SEQ ID NO: 100 - protein, 879 aa, Artificial Sequence
  Description of Artificial Sequence: Synthetic polypeptide
  MOD_RES (729)..(729): Cys, Ala or Thr
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDASGAAAKPATTEGEFPETREKMSGIRRAIAKAMVHSKHTAPHVTLMDEADVTKLVAHRKKFKAIAAEKGIKLTFLPYVVKALVSALREYPVLNTXIDDETEEIIQKHYYNIGIAADTDRGLLVPVIKHADRKPIFALAQEINELAEKARDGKLTPGEMKGASCTITNIGSAGGQWFTPVINHPEVAILGIGRIAEKPIVRDGEIVAAPMLALSLSFDHRMIDGATAQKALNHIKRLLSDPELLLM

SEQ ID NO: 101 - protein, 686 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLS

SEQ ID NO: 102 - protein, 686 aa, Artificial Sequence
  Description of Artificial Sequence: Synthetic polypeptide
AENLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLS

SEQ ID NO: 103 - protein, 833 aa, Artificial Sequence
  Description of Artificial Sequence: Synthetic polypeptide
AENLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 104 - protein, 713 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDGGGSGGSGGSEQKLISEEDLGGSGGSGGSNAVGQDTQEVIVVPHSLPFKVVVISAILALVVLTIISLIILIMLWQKKPR

SEQ ID NO: 105 - protein, 713 aa, Artificial Sequence
  Description of Artificial Sequence: Synthetic polypeptide
AENLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDGGGSGGSGGSEQKLISEEDLGGSGGSGGSNAVGQDTQEVIVVPHSLPFKVVVISAILALVVLTIISLIILIMLWQKKPR

SEQ ID NO: 106 - protein, 721 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGSHSGSGGSGSGGHAAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDGGGSGGSGGSEQKLISEEDLGGSGGSGGSNAVGQDTQEVIVVPHSLPFKVVVISAILALVVLTIISLIILIMLWQKKPR

SEQ ID NO: 107 - protein, 694 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGSHSGSGGSGSGGHAAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLS

SEQ ID NO: 108 - protein, 694 aa, Artificial Sequence
  Description of Artificial Sequence: Synthetic polypeptide
AENLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGSHSGSGGSGSGGHAAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLS

SEQ ID NO: 109 - protein, 721 aa, Artificial Sequence
  Description of Artificial Sequence: Synthetic polypeptide
AENLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGSHSGSGGSGSGGHAAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALDGGGSGGSGGSEQKLISEEDLGGSGGSGGSNAVGQDTQEVIVVPHSLPFKVVVISAILALVVLTIISLIILIMLWQKKPR

SEQ ID NO: 110 - protein, 709 aa, Artificial Sequence
  Description of Artificial Sequence: Synthetic polypeptide
VSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLGGNGSGGGSGSGGNGSSGLWVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRGGGSGGSGGSEQKLISEEDLGGSGGSGGSNAVGQDTQEVIVVPHSLPFKVVVISAILALVVLTIISLIILIMLWQKKPR

SEQ ID NO: 111 - protein, 674 aa, Artificial Sequence
  Description of Artificial Sequence: Synthetic polypeptide
VSLGFLGAAGSTMGAASMTLTVQARNLLSGIVQQQSNLLRAPEPQQHLLKDTHWGIKQLQARVLAVEHYLRDQQLLGIWGCSGKLICCTGGSGVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGGSGSGVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLS

SEQ ID NO: 112 - protein, 704 aa, Artificial Sequence
  Description of Artificial Sequence: Synthetic polypeptide
VSLGFLGAAGSTMGAASMTLTVQARNLLSGIVQQQSNLLRAPEPQQHLLKDTHWGIKQLQARVLAVEHYLRDQQLLGIWGCSGKLICCTGGSGVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGGSGSGVPWNSSWSNRNLSEIWDNMTWLQWDKEISNYTQIIYGLLEESQNQQEKNNQSLLALDNGSGGGSGGSGGSEQKLISEEDLGGSGGSGGSNAVGQDTQEVIVVPHSLPFKVVVISAILALVVLTIISLIILIMLWQKKPR

SEQ ID NO: 113 - protein, 821 aa, Artificial Sequence
  Description of Artificial Sequence: Synthetic polypeptide
VSLGFLGAAGSTMGAASMTLTVQARNLLSGIVQQQSNLLRAPEPQQHLLKDTHWGIKQLQARVLAVEHYLRDQQLLGIWGCSGKLICCTGGSGVTVYYGVPVWKDAETTLFCASDAKAYETEKHNVWATHACVPTDPNSSEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCQNVSTVQCTHGIKPVVSTQLLLNGSLAEEEVIIRSENITNNAKNILVQLNTSVQINCTRPNNNTVKSIRIGPGQAFYYTGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGGSGSGVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 114 - protein, 6 aa, Artificial Sequence
  Description of Artificial Sequence: Synthetic 6xHis tag
HHHHHH

SEQ ID NO: 115 - protein, 9 aa, Artificial Sequence
  Description of Artificial Sequence: Synthetic peptide
GTKHHHHHH

SEQ ID NO: 116 - protein, 4 aa, Artificial Sequence
  Description of Artificial Sequence: Synthetic peptide
GSGG

SEQ ID NO: 117 - protein, 748 aa, Artificial Sequence
  Description of Artificial Sequence: Synthetic polypeptide
MDAMKRGLCCVLLLCGAVFVSPSQEIHARFRRGARAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGELGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGSGGSGGSEQKLISEEDLGGSGGSGGSNAVGQDTQEVIVVPHSLPFKVVVISAILALVVLTIISLIILIMLWQKKPR

SEQ ID NO: 118 - protein, 574 aa, Artificial Sequence
  Description of Artificial Sequence: Synthetic polypeptide
METDTLLLWVLLLWVPGSTGDAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGSGGSEQKLISEEDLGGSGGSGGSNAVGQDTQEVIVVPHSLPFKVVVISAILALVVLTIISLIILIMLWQKKPR

SEQ ID NO: 119 - protein, 126 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARITIFGVVIIYYYYYYMDVWGKGTTVTVSS

SEQ ID NO: 120 - protein, 132 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARTLHGITIFGVVAFKEYYYYYYMDVWGKGTTVTVSS

SEQ ID NO: 121 - protein, 132 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARTLHGITIFGVVIIKEYYYYYYMDVWGKGTTVTVSS

SEQ ID NO: 122 - protein, 132 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARTQQGKRIYGVVSFGEYYYYYYMDVWGKGTTVTVSS

SEQ ID NO: 123 - protein, 132 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARTQQGKRIYGVVSFGDYYYYYYMDVWGKGTTVTVSS

SEQ ID NO: 124 - protein, 132 aa, Artificial Sequence; identical to SEQ ID NO: 120
  Description of Artificial Sequence: Synthetic polypeptide

SEQ ID NO: 125 - protein, 132 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARTLHGRRIYGIVAFKEWFTYYYMDVWGKGTTVTVSS

SEQ ID NO: 126 - protein, 132 aa, Artificial Sequence; identical to SEQ ID NO: 125
  Description of Artificial Sequence: Synthetic polypeptide

SEQ ID NO: 127 - protein, 132 aa, Artificial Sequence; identical to SEQ ID NO: 125
  Description of Artificial Sequence: Synthetic polypeptide

SEQ ID NO: 128 - protein, 132 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSS

SEQ ID NO: 129 - protein, 109 aa, Artificial Sequence
  Description of Artificial Sequence: Synthetic polypeptide
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHPWVFGGGTKLTVL

SEQ ID NO: 130 - protein, 109 aa, Artificial Sequence; identical to SEQ ID NO: 129
  Description of Artificial Sequence: Synthetic polypeptide

SEQ ID NO: 131 - protein, 109 aa, Artificial Sequence
  Description of Artificial Sequence: Synthetic polypeptide
SYVLTQPPSVSVAPGQTARITCGGNNIGSKSVHWYQQKPGQAPVLVVYDDSDRPSGIPERFSGSNSGNTATLTISRVEAGDEADYYCQVWDSRGPTNWVFGGGTKLTVL

SEQ ID NO: 132 - protein, 109 aa, Artificial Sequence; identical to SEQ ID NO: 129
  Description of Artificial Sequence: Synthetic polypeptide

SEQ ID NO: 133 - protein, 109 aa, Artificial Sequence; identical to SEQ ID NO: 129
  Description of Artificial Sequence: Synthetic polypeptide

SEQ ID NO: 134 - protein, 109 aa, Artificial Sequence; identical to SEQ ID NO: 131
  Description of Artificial Sequence: Synthetic polypeptide

SEQ ID NO: 135 - protein, 109 aa, Artificial Sequence
  Description of Artificial Sequence: Synthetic polypeptide
SYVLTQPPSVSVAPGKTARITCGGNNIGSKSVHWYQQKPGQAPVLVIYDDSDRPSGIPERFSGSNSGNTATLTISRVEAGDEADYYCQVWDSRSDHPWVFGGGTKLTVL

SEQ ID NO: 136 - protein, 109 aa, Artificial Sequence; identical to SEQ ID NO: 131
  Description of Artificial Sequence: Synthetic polypeptide

SEQ ID NO: 137 - protein, 109 aa, Artificial Sequence
  Description of Artificial Sequence: Synthetic polypeptide
SYVLTQPPSVSVAPGETARISCGGNNIGSKSVQWYQQKPGQAPVLVVYNNQDRPSGIPERFSGSPDGNTATLTISRVEAGDEADYYCQVWDSRSDHPWVFGGGTKLTVL

SEQ ID NO: 138 - protein, 105 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVL

SEQ ID NO: 139 - protein, 543 aa, Artificial Sequence
  Description of Artificial Sequence: Synthetic polypeptide
LTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 140 - protein, 543 aa, Artificial Sequence
  Description of Artificial Sequence: Synthetic polypeptide
LTPLCVTLQCTNVTNNIIDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 141 - protein, 543 aa, Artificial Sequence
  Description of Artificial Sequence: Synthetic polypeptide
LTPLCVTLQCTNVANNIIDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 142 - protein, 543 aa, Artificial Sequence
  Description of Artificial Sequence: Synthetic polypeptide
LTPLCVTLQCTNYTPNLTNDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 143 - protein, 543 aa, Artificial Sequence
  Description of Artificial Sequence: Synthetic polypeptide
LTPLCVTLQCTNYTPNLINDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 144 - protein, 543 aa, Artificial Sequence
  Description of Artificial Sequence: Synthetic polypeptide
LTPLCVTLQCTNYAPNLINDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 145 - protein, 543 aa, Artificial Sequence
  Description of Artificial Sequence: Synthetic polypeptide
LTPLCVTLQCTNYAPFLINDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRMAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 146 - protein, 370 aa, Artificial Sequence
  Description of Artificial Sequence: Synthetic polypeptide
LTPLCVTLQCTNYRPNLINDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRMAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEP

SEQ ID NO: 147 - protein, 370 aa, Artificial Sequence
  Description of Artificial Sequence: Synthetic polypeptide
LTPLCVTLQCTNYAPFLINDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNARKSIRIGPGQAFYAFGDIIGDIRMAACTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEP

SEQ ID NO: 148 - protein, 370 aa, Artificial Sequence
  Description of Artificial Sequence: Synthetic polypeptide
LTPLCVTLQCTNYAPFLINDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYAFGDIIGDIRMAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEP

SEQ ID NO: 149 - protein, 543 aa, Artificial Sequence
  Description of Artificial Sequence: Synthetic polypeptide
LTPLCVTLQCTNYAPFLINDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYAFGDIIGDIRMAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 150 - protein, 543 aa, Artificial Sequence
  Description of Artificial Sequence: Synthetic polypeptide
LTPLCVTLQCTNYAPFLINNMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYTTGDIIGDIRMAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 151 - protein, 543 aa, Artificial Sequence
  Description of Artificial Sequence: Synthetic polypeptide
LTPLCVTLQCTNYAPFLINNMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYAFGDIIGDIRMAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 152 - protein, 543 aa, Artificial Sequence
  Description of Artificial Sequence: Synthetic polypeptide
LTPLCVTLQCTNYAPNLLSNMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTVKSIRIGPGQAFYYFGDIIGDIRMAHCNVSKATWNETLGKVVKQLRKHFGNNTIIRFAQSSGGDLEVTTHSFNCGGEFFYCNTSGLFNSTWISNTSVQGSNSTGSNDSIVLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 153 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 154 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVIIRSENITNNAKNILVQLNAPVQINCTRPNNNTRKSIRIGPGQAFYATGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 155 - protein, 634 aa, Artificial Sequence; identical to SEQ ID NO: 27
  Description of Artificial Sequence: Synthetic polypeptide

SEQ ID NO: 156 - protein, 634 aa, Artificial Sequence; identical to SEQ ID NO: 35
  Description of Artificial Sequence: Synthetic polypeptide

SEQ ID NO: 157 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQQHLLKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 158 - protein, 634 aa, Artificial Sequence; identical to SEQ ID NO: 25
  Description of Artificial Sequence: Synthetic polypeptide

SEQ ID NO: 159 - protein, 634 aa, Artificial Sequence; identical to SEQ ID NO: 25
  Description of Artificial Sequence: Synthetic polypeptide

SEQ ID NO: 160 - protein, 634 aa, Artificial Sequence; identical to SEQ ID NO: 50
  Description of Artificial Sequence: Synthetic polypeptide

SEQ ID NO: 161 - protein, 653 aa, Artificial Sequence; identical to SEQ ID NO: 52
  Description of Artificial Sequence: Synthetic polypeptide

SEQ ID NO: 162 - protein, 661 aa, Artificial Sequence; identical to SEQ ID NO: 54
  Description of Artificial Sequence: Synthetic polypeptide

SEQ ID NO: 163 - protein, 626 aa, Artificial Sequence; identical to SEQ ID NO: 56
  Description of Artificial Sequence: Synthetic polypeptide

SEQ ID NO: 164 - protein, 634 aa, Artificial Sequence
  Description of Artificial Sequence: Synthetic polypeptide
AENLWVTVYYGVPVWKDAETTLFCASDAKAYETEKHNVWATHACVPTDPNPQEIHLENVTEEFNMWKNNMVEQMHEDIISLWDQSLKPCCKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVIIRSENITNNAKNILVQLNTPVQINCTRPNNNTRKSIRIGPGCAFYATGDIIGDIRQAHCNVSKATWNETLGKVVKQLRKHFGNNTIIRFAQSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVSLGFLGAAGSTMGAASMTLTVQARNLLSGIVQQQSNLLRAPEPQEHLHKDTHWGIKQLQARVLAVEHYLRDQQLLGIWGCSGKLICCTNVPWNSSWSNRNLSEIWDNMTWLQWDKEISNYTQIIYGLLEESQNQQEKNEQDLLALD

SEQ ID NO: 165 - protein, 11 aa, Artificial Sequence
  Description of Artificial Sequence: Synthetic peptide
NQSLLALDNGS

What is claimed is:

1. A non-naturally occurring protein comprising a Type I immunogen, wherein the Type I immunogen is a gp120 trimer comprising an amino acid sequence selected from the group consisting of:

```
(a) BG505-gp120-L111A-2_T135A_T139I_mC
(BG505-gp120 3mut)
                                      (SEQ ID NO: 1)
VWKDAETTLFCASDAKAYETEKHNVWATHACVPTDPNPQEIHLENVTEEF

NMWKNNMVEQMHTDIISAWDQSLKPCVKLTPLCVTLQCTNVANNIIDDMR

GELKNCSFNMTTELRDKKQKVYSLFYRLDVVQINENQGNRSNNSNKEYRL

INCNTSAITQACPKVSFEPIPIHYCAPAGFAILKCKDKKFNGTGPCPSVS

TVQCTHGIKPVVSTQLLLNGSLAEEEVMIRSENITNNAKNILVQFNTPVQ

INCTRPNNNTRKSIRIGPGQAFYATGDIIGDIRQAHCNVSKATWNETLGK

VVKQLRKHFGNNTIIRFANSSGGDLEVTTHSFNCGGEFFYCNTSGLFNST

WISNTSVQGSNSTGSNDSITLPCRIKQIINMWQRIGQAMYAPPIQGVIRC

VSNITGLILTRDGGSTNSTTETFRPGGGDMRDNWRSELYKYKVVKIEP
```

-continued
```
(b) BG505-gp120-L111A-2_5mut_mC (BG505-gp120 5mut)
                                      (SEQ ID NO: 3)
VWKDAETTLFCASDAKAYETEKHNVWATHACVPTDPNPQEIHLENVTEEF

NMWKNNMVEQMHTDIISAWDQSLKPCVKLTPLCVTLQCTNYTPNLTNDMR

GELKNCSFNMTTELRDKKQKVYSLFYRLDVVQINENQGNRSNNSNKEYRL

INCNTSAITQACPKVSFEPIPIHYCAPAGFAILKCKDKKFNGTGPCPSVS

TVQCTHGIKPVVSTQLLLNGSLAEEEVMIRSENITNNAKNILVQFNTPVQ

INCTRPNNNTRKSIRIGPGQAFYATGDIIGDIRQAHCNVSKATWNETLGK

VVKQLRKHFGNNTIIRFANSSGGDLEVTTHSFNCGGEFFYCNTSGLFNST

WISNTSVQGSNSTGSNDSITLPCRIKQIINMWQRIGQAMYAPPIQGVIRC

VSNITGLILTRDGGSTNSTTETFRPGGGDMRDNWRSELYKYKVVKIEP (c) BG505-gp120-L111A-2_7mut_mC
(BG505-gp120 7mut or BG505 gp120 7MUT)
                                      (SEQ ID NO: 5)
VWKDAETTLFCASDAKAYETEKHNVWATHACVPTDPNPQEIHLENVTEEF

NMWKNNMVEQMHTDIISAWDQSLKPCVKLTPLCVTLQCTNYAPNLINDMR

GELKNCSFNMTTELRDKKQKVYSLFYRLDVVQINENQGNRSNNSNKEYRL
```

INCNTSAITQACPKVSFEPIPIHYCAPAGFAILKCKDKKFNGTGPCPSVS

TVQCTHGIKPVVSTQLLLNGSLAEEEVMIRSENITNNAKNILVQFNTPVQ

INCTRPNNNTRKSIRIGPGQAFYATGDIIGDIRQAHCNVSKATWNETLGK

VVKQLRKHFGNNTIIRFANSSGGDLEVTTHSFNCGGEFFYCNTSGLFNST

WISNTSVQGSNSTGSNDSITLPCRIKQIINMWQRIGQAMYAPPIQGVIRC

VSNITGLILTRDGGSTNSTTETFRPGGGDMRDNWRSELYKYKVVKIEP (d) BG505-gp120-L111A-2_10mut_mC
(BG505-gp120 10mut or BG505 gp120 10MUT)
(SEQ ID NO: 7)
VWKDAETTLFCASDAKAYETEKHNVWATHACVPTDPNPQEIHLENVTEEF

NMWKNNMVEQMHTDIISAWDQSLKPCVKLTPLCVTLQCTNYAPFLINDMR

GELKNCSFNMTTELRDKKQKVYSLFYRLDVVQINENQGNRSNNSNKEYRL

INCNTSAITQACPKVSFEPIPIHYCAPAGFAILKCKDKKFNGTGPCPSVS

TVQCTHGIKPVVSTQLLLNGSLAEEEVMIRSENITNNAKNILVQFNTPVQ

INCTRPNNNTRKSIRIGPGQAFYAFGDIIGDIRMAHCNVSKATWNETLGK

VVKQLRKHFGNNTIIRFANSSGGDLEVTTHSFNCGGEFFYCNTSGLFNST

WISNTSVQGSNSTGSNDSITLPCRIKQIINMWQRIGQAMYAPPIQGVIRC

VSNITGLILTRDGGSTNSTTETFRPGGGDMRDNWRSELYKYKVVKIEP (e) BG505-gp120-L111A-2_10mut2A_mC
(SEQ ID NO: 9)
VWKDAETTLFCASDAKAYETEKHNVWATHACVPTDPNPQEIHLENVTEEF

NMWKNNMVEQMHTDIISAWDQSLKPCVKLTPLCVTLQCTNYAPFLINNMR

GELKNCSFNMTTELRDKKQKVYSLFYRLDVVQINENQGNRSNNSNKEYRL

INCNTSAITQACPKVSFEPIPIHYCAPAGFAILKCKDKKFNGTGPCPSVS

TVQCTHGIKPVVSTQLLLNGSLAEEEVMIRSENITNNAKNILVQFNTPVQ

INCTRPNNNTRKSIRIGPGQAFYAFGDIIGDIRMAHCNVSKATWNETLGK

VVKQLRKHFGNNTIIRFANSSGGDLEVTTHSFNCGGEFFYCNTSGLFNST

WISNTSVQGSNSTGSNDSITLPCRIKQIINMWQRIGQAMYAPPIQGVIRC

VSNITGLILTRDGGSTNSTTETFRPGGGDMRDNWRSELYKYKVVKIEP and (f) BG505-gp120-L111A-2_11mut2A_mC
(SEQ ID NO: 11)
VWKDAETTLFCASDAKAYETEKHNVWATHACVPTDPNPQEIHLENVTEEF

NMWKNNMVEQMHTDIISAWDQSLKPCVKLTPLCVTLQCTNYAPNLLSNMR

GELKNCSFNMTTELRDKKQKVYSLFYRLDVVQINENQGNRSNNSNKEYRL

INCNTSAITQACPKVSFEPIPIHYCAPAGFAILKCKDKKFNGTGPCPSVS

TVQCTHGIKPVVSTQLLLNGSLAEEEVMIRSENITNNAKNILVQFNTPVQ

INCTRPNNNTRKSIRIGPGQAFYAFGDIIGDIRMAHCNVSKATWNETLGK

VVKQLRKHFGNNTIIRFANSSGGDLEVTTHSFNCGGEFFYCNTSGLFNST

WISNTSVQGSNSTGSNDSIVLPCRIKQIINMWQRIGQAMYAPPIQGVIRC

VSNITGLILTRDGGSTNSTTETFRPGGGDMRDNWRSELYKYKVVKIEP.

2. A monomeric protein of claim 1.

3. The protein of claim 1, further comprising a tag for purification or biotinylation.

4. The protein of claim 3, wherein the tag for purification is a his tag.

5. The protein of claim 3, wherein the tag for biotinylation is an avi-tag.

6. The protein of claim 1, further comprising an additional cysteine.

7. The protein of claim 1 fused to a multimerization motif.

* * * * *